(12) United States Patent
Flavell et al.

(10) Patent No.: US 11,603,536 B2
(45) Date of Patent: *Mar. 14, 2023

(54) METHODS FOR EFFICIENT MAIZE GENOME EDITING

(71) Applicant: Inari Agriculture Technology, Inc., Cambridge, MA (US)

(72) Inventors: Richard Bailey Flavell, Malibu, CA (US); Yajie Niu, Lexington, MA (US); Michael Lee Nuccio, Salem, NH (US); Randall William Shultz, Acton, MA (US); Davide Sosso, Cambridge, MA (US); Maria Margarita D. Unson, Pawcatuck, CT (US); John Patrick Casey, Jr., Boston, MA (US); Barry Andrew Martin, Boston, MA (US)

(73) Assignee: INARI AGRICULTURE TECHNOLOGY, INC., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/146,871

(22) Filed: Sep. 28, 2018

(65) Prior Publication Data

US 2022/0315941 A1    Oct. 6, 2022

Related U.S. Application Data

(60) Provisional application No. 62/566,180, filed on Sep. 29, 2017.

(51) Int. Cl.
  *C12N 15/82*  (2006.01)

(52) U.S. Cl.
  CPC ..... *C12N 15/8261* (2013.01); *C12N 15/8213* (2013.01)

(58) Field of Classification Search
  None
  See application file for complete search history.

(56) References Cited

U.S. PATENT DOCUMENTS

| | | | |
|---|---|---|---|
| 7,422,889 B2 | 9/2008 | Sauer et al. | |
| 7,691,995 B2 | 4/2010 | Zamore et al. | |
| 7,786,350 B2 | 8/2010 | Allen et al. | |
| 8,030,473 B2 | 10/2011 | Carrington et al. | |
| 8,314,290 B2 | 11/2012 | Allen et al. | |
| 8,334,430 B2 | 12/2012 | Allen et al. | |
| 8,395,023 B2 | 3/2013 | Gilbertson et al. | |
| 8,404,928 B2 | 3/2013 | Allen et al. | |
| 8,410,334 B2 | 4/2013 | Allen et al. | |
| 8,697,359 B1 * | 4/2014 | Zhang | C12N 9/96 435/6.1 |
| 8,748,699 B2 | 6/2014 | Reuzeau et al. | |
| 8,816,153 B2 | 8/2014 | Gilbertson et al. | |
| 8,946,511 B2 | 2/2015 | Allen et al. | |
| 9,040,774 B2 | 5/2015 | Ivashuta et al. | |
| 9,139,838 B2 | 9/2015 | Huang et al. | |
| 9,192,112 B2 | 11/2015 | Allen et al. | |
| 2009/0293148 A1 | 11/2009 | Ren et al. | |
| 2013/0326645 A1 * | 12/2013 | Cost | C12N 15/8286 435/468 |
| 2015/0079680 A1 * | 3/2015 | Bradley | C07K 16/00 435/462 |
| 2015/0082478 A1 | 3/2015 | Cigan et al. | |
| 2015/0307889 A1 | 10/2015 | Petolino et al. | |
| 2016/0326548 A1 * | 11/2016 | Cost | C12N 15/85 |
| 2017/0037432 A1 * | 2/2017 | Donohoue | C12N 9/96 |
| 2017/0166912 A1 | 6/2017 | Brower-Toland et al. | |
| 2019/0264218 A1 | 8/2019 | Shultz et al. | |
| 2019/0352655 A1 | 11/2019 | Niu et al. | |

FOREIGN PATENT DOCUMENTS

| | | |
|---|---|---|
| CN | 104450745 A | 3/2015 |
| WO | 2013160230 A1 | 10/2013 |
| WO | 2015006294 A2 | 1/2015 |
| WO | 2015131101 A1 | 9/2015 |
| WO | 2016007347 A1 | 1/2016 |
| WO | 2016007948 A1 | 1/2016 |
| WO | 2016105185 A1 | 6/2016 |
| WO | 2016123514 A1 | 8/2016 |

OTHER PUBLICATIONS

Yanagisawa et al., 2014, Metabolic engineering with Dof1 transcription factor in plants: Improved nitrogen assimilation and growth under low-nitrogen conditions, Proceedings of the National Academy of Sciences USA 101: 7833-7838.*
Svitashev et al., 2015, Targeted Mutagenesis, Precise Gene Editing, and Site-Specific Gene Insertion in Maize Using Cas9 and Guide RNA, Plant Physiology 169: 931-945.*
Zea mays Dof zinc finger protein MNB1A (LOC100283759), GenBank accession No. NM_001156658, published on Apr. 17, 2013.*
Zea mays cv. Liaobai371 glutamine synthetase (gln1-3) gene, GenBank accession No. EU338535, published on Feb. 1, 2009.*
Mitra et al., 2017, Diversity in binding, regulation, and evolution revealed from high-throughput ChIP, PLOS Computational Biology 14(4):e1006090, pp. 1-20.*
Ma et al., 2015, A Robust CRISPR/Cas9 System for Convenient, High-Efficiency Multiplex Genome Editing in Monocot and Dicot Plants, Molecular Plant 8: 1274-1284.*
Martin et al., 2006, Two Cytosolic Glutamine Synthetase Isoforms of Maize Are Specifically Involved in the Control of Grain Production, The Plant Cell 18: 3252-3274.*
Lyznik et al., 2012, Double-Strand Break-Induced Targeted Mutagenesis in Plants, In: Transgenic Plants, Methods in Molecular Biology, vol. 847, pp. 399-416.*
He et al., 2017, Genomic features shaping the landscape of meiotic double-strand-break hotspots in maize, Proc. Natl. Acad. Sci. USA 114: 12231-12236.*

(Continued)

*Primary Examiner* — Cynthia E Collins

(74) *Attorney, Agent, or Firm* — McKee, Voorhees & Sease, PLC

(57) ABSTRACT

The invention relates to novel maize plants, seeds and compositions, as well as improvements to maize plant breeding and methods for creating modifications in maize plant genomes.

13 Claims, 9 Drawing Sheets

Specification includes a Sequence Listing.

(56) References Cited

OTHER PUBLICATIONS

Svitashev et al., 2016, Genome editing in maize directed by CRISPR-Cas9 ribonucleoprotein complexes, Nature Communications 7:13274, pp. 1-7.*
Gaj et al., 2013, Genome-Editing Technologies: Principles and Applications, Cold Spring Harb Perspect Biol 2016;8:a023754, pp. 1-20.*
"CrispRVariants: Tools for Counting and Visualising Mutations in a Target Location", Bioconductor, Retrieved Nov. 9, 2018, 4 pages, Release 3.8.
"ERISdb Database of Plant Splice Sites and Splicing Signals", ERISdb: a Database of Plant Splice Sites, Retrieved Nov. 9, 2018, 1 page.
AddGene, "Targeted DNA demethylation in vivo using dCas9-peptide repeat and scFv-TET1 catalytic domain fusions," 2016, Retrieved from https:/www.addgene.org/browse/article/22324 on Nov. 9, 2018, 1 page.
AtcisDB—Arabidopsis cis-regulatory element Database; downloaded on Jan. 30, 2019 from <https://agris-knowledgebase.org/AtcisDB/>.
Broothaerts et al., "Gene Transfer to Plants by Diverse Species of Bacteria", Nature, Feb. 10, 2005, pp. 629-633, vol. 433.
Buchanan et al., "Phylogentic Analysis of 5'-Noncoding Regions from the ABA-Responsive rab16/17 Gene Family of Sorghum, Maize and Rice Provides Insight into the Composition, Organization and Function of cis-Regulatory Modules", Genetics, Nov. 1, 2004, pp. 1639-1654, vol. 168, No. 3.
Family: SPX (PF03105), Retrieved from https://pfam.xfam.org/family/SPX on Nov. 9, 2018.
Je et al., "Signaling from Maize Organ Primordia via FASCIATED EAR3 Regulates Stem Cell Proliferation and Yield Traits", Nature Genetics, 2016, pp. 785-791, vol. 48, No. 7.
Kagale et al., "EAR Motif-mediated Transcriptional Repression in Plants", Epigenetics, 2011, pp. 141-146, vol. 6, No. 2.
Kurai et al., "Introduction of the ZmDof1 Gene into Rice Enhances Carbon and Nitrogen Assimilation Under Low-nitrogen Conditions", Plant Biotechnology, 2011, pp. 826-837, vol. 9.
Li et al., "High-efficiency Breeding of Early-maturing Rice Cultivars via CRISPR/Cas9-mediated Genome Editing", Journal of Genetics and Genomics, 2017.
Liang et al., "Efficient DNA-free Genome Editing of Bread Wheat Using CRISPR/Cas9 Ribonucleoprotein Complexes", Nature Communications, Jan. 18, 2017, vol. 8, No. 14261.
Lyznik et al., "FLP-mediated Recombination of FRT Sites in the Maize Genome", Nucleic Acids Research, 1996, pp. 3784-3789, vol. 24, No. 19.
Maeser et al., "The Gin Recombinase of Phage Mu can Catalyse Site-specific Recombination in Plant Protoplasts", 1991, pp. 170-176, vol. 230.
Maize Genetics and Genomics Database, (https://www.maizegdb.org/), Retrieved Nov. 9, 2018.
Maize TFome Collection; downloaded on Jan. 30, 2019 from <https://www.grassius.org/tfomecollection.php>.
Mao et al., "A Transposable Element in a NAC Gene is Associated with Drought Tolerance in Maize Seedlings", Nature Communications, Sep. 21, 2015.
Medrano et al., "From Leaf to Whole-plant Water Use Efficiency (WUE) in Complex Canopies: Limitations of Leaf WUE as a Selection Target", The Crop Journal, 2015, pp. 220-228, vol. 3.
Molla et al., "Tissue-Specific Expression of Arabidopsis NPR1 Gene in Rice for Sheath Blight Resistance Without Compromising Phenotypic Cost", Plant Science, 2016, pp. 105-114, vol. 250.
Morita et al., "Targeted DNA Demethylation in Vivo Using dCas9-peptide Repeat and scFv-TET1 Catalytic Domain Fusions", Bature Biotechnology, Aug. 29, 2016, pp. 1060-1065, vol. 34.
O'Malley et al., "Cistrome and Epicistrome Features Shape the Regulatory DNA Landscape", Cell, 2016, pp. 1280-1292, vol. 165.

Odell et al., "Seed-Specific Gene Activation Mediated by the Cre/lox Site Specific Recombination System", Plant Physiology, 1994, pp. 447-458, vol. 106.
Onouchi et al., "Operation of an Efficient Site-Specific Recombination System of Zygosaccharomyces rouxii in Tabacco Cells", Nucleic Acids Research, 1991, pp. 6373-6378, vol. 19, No. 23.
Peter et al., "Mechanism of Signal Transduction of the LOV2-Ja Photosensor from Avena sativa", Nature Communications, Nov. 16, 2010, 7 pages, vol. 1, No. 122.
Peterson et al., "Genome-Wide Assessment of Efficiency and Specificity in CRISPR/Cas9 Mediated Multiple Site Targeting in Arabidopsis", PLOS One, Sep. 13, 2016, 11 pages.
Quilis et al., "The Arabidopsis AtNPR1 Inversely Modulates Defense Responses Against Fungal, Bacterial, or Viral Pathogens While conferring Hypersensitivity to Abiotic Stresses in Transgenic Rice", Molecular Plant-Microbe Interactions, 2008, pp. 1215-1231, vol. 21, No. 9.
Shen et al., "Rapid Generation of Genetic Diversity by Multiplex CRISPR/Cas9 Genome Editing in Rice", Science China Life Sciences, May 2017, pp. 506-515, vol. 60, No. 5.
Stroud et al., "Plants Regenerated from Tissue Culture Contain Stable Epigenome Changes in Rice", Chromosomes and Gene Expression, Plant Biology, 2013, 14 pages.
Sun et al., "Altered Expression of Maize PLASTOCHRON1 Enhances Biomass and Seed Yield by Extending Cell Division Duration", Nature Communications, Mar. 16, 2017, 11 pages, vol. 8.
Taylor et al., "PAS Domains: Internal Sensors of Oxygen, Redox Potential, and Light", Microbiology and Molecular Biology Reviews, Jun. 1999, pp. 479-506, vol. 63, No. 2.
Thatcher et al., "Genome-Wide Analysis of Alternative Splicing in Zea mays: Landscape and Genetic Regulation", The Plant Cell, Sep. 2014, 16 pages.
Ulmasov et al., "Aux.IAA Proteins Repress Expression of Reporter Genes Containing Natural and Highly Active Synthetic Auxin Response Elements", The Plant Cell, Nov. 1997, pp. 1963-1971, vol. 9.
UniProtKB Accession No. B9TSW5, "Gln1-4—Glutamine synthetase—Zea mays (Maize)", Retrieved Nov. 9, 2018, https://www.uniprot.org/uniprot/B9TSW5, 5 pages.
UniProtKB Accession No. Q1HFQ1, Retrieved Nov. 9, 2018, https://www.uniprot.org/uniprot/Q1HFQ1, 5 pages.
UniProtKB Accession No. Q53CL7, "Nitrate transport2", Retrieved Nov. 9, 2018, https://www.uniprot.org/uniprot/Q53CL7, 5 pages.
Walker et al., "Molecular Mechanisms of Auxin Action", Current Opinion in Plant Biology, 1998, pp. 434-439, vol. 1.
Wang et al., "Structure and Expression Profile of the Arabidopsis PHO1 Gene Family Indicates a Broad Role in Inorganic Phosphate Homeostasis", Plant Physiology, May 2004, pp. 400-411, vol. 135.
Xing et al., "A CRISPR/Cas9 Toolkit for Multiplex Genome Editing in Plants", BMC Plant Biology, 2014, 12 pages, vol. 14, No. 327.
Zetsche et al., "Cpf1 is a Single RNA-Guided Endonuclease of a Class 2 CRISPR-Cas System", Cell, 2015, pp. 759-771, vol. 163, No. 3.
Zoltowski et al., "Conformational Switching in the Fungal Light Sensor Vivid", Science, May 18, 2007, pp. 1054-1057, vol. 316, No. 5827.
Bartlett et al., "Mapping Genome-Wide Transcription Factor Binding Sites Using DAP-Seq", Nat. Protoc., 2017, pp. 1659-1672, vol. 12, No. 8.
Bortesi et al., "The CRISPR/Cas9 System for Plant Genome Editing and Beyond", Biotechnology Advances, 2015, pp. 41-52, vol. 33, No. 1.
Burgess et al., "Advances in Understanding Cis Regulation of the Plant Gene with Emphasis on Comparative Genomics", Current Opinion in Plant Biology, 2015, pp. 141-147, vol. 27.
ERISdb: a Database of Plant Splice Sites downloaded from <http://lemur.amu.edu.pl/share/ERISdb/home.html> on Mar. 2, 2020.
He et al., "Improved Regulatory Element Prediction Based on Tissue-Specific Local Epigenomic Signatures", PNAS, 2017, pp. 1633-1640.
Martin et al., "Two Cytosolic Glutamine Synthetase Isoforms of Maize Are Specifically Involved in the Control of Grain Production", The Plant Cell, Nov. 2006, pp. 3252-3274, vol. 18.

(56) References Cited

OTHER PUBLICATIONS

Mout et al., "Directed Cytosolic Delivery of CRISPR/Cas9-Ribonucleoprotein for Efficient Gene Editing", ACS Nano, 2017, pp. 2452-2458, vol. 11.
Office Action for U.S. Appl. No. 16/261,233 dated Jun. 12, 2020.
Oka et al., "Genome-Wide Mapping of Transcriptional Enhancer Candidates Using DNA and Chromatin Features in Maize", Genome Biology, 2017, 24 pages, vol. 18. No. 137.
Schaeffer et al., "CRISPR/Cas9-Mediated Genome Editing and Gene Replacement in Plants: Transitioning from Lab to Field", Plant Science, 2015, pp. 130-142, vol. 240.
Soyk et al., "Bypassing Negative Epistasis on Yield in Tomato Imposed by a Domestication Gene", Cell, 2017, pp. 1142-1155, vol. 169.
Szczesniak et al., "ERISdb: A Database of Plant Splice Sites and Splicing Signals", Plant Cell Physiol., 2013, 8 pages. vol. 54, No. 2.
You et al., "Design of LNA probes that improve mismatch discrimination", Nucleic Acids Research, 2006, 11 pages, vol. 34, No. 8.
Andersson et al., "Efficient Targeted Multiallelic Mutagenesis in Tetraploid Potato (*Solanum tuberosum*) by Transient CRISPR-Cas9 Expression in Protoplasts", Plant Cell Rep., 2017, pp. 117-128, vol. 36.
Bahal et al, "In vivo correction of anaemia in b-thalassemic mice by gPNA-mediated gene editing with nanoparticle deliver", Nature Communications, Oct. 26, 2016, pp. 1-14.
Baskaran et al, "Gene delivery using microinjection of agrobacterium to embryonic shoot apical meristem of elite indica rice cultivars", J. Plant Biochem. Biotechnol., Jul.-Dec. 2012, pp. 268-274, vol. 21, No. 2.
Burstein et al, "New CRISPR-Cas systems from uncultivated microbes", Nature, Feb. 9, 2017, pp. 237-241, vol. 542, No. 7640.
Davies et al, "Identification and use of the sugarcane bacilliform virus enhancer in transgenic maize", BMC Plant Biology, 2014, pp. 1-12, vol. 14, No. 359.
Ferré-D'-Amaré et al, "Small Self-Cleaving Ribozymes", 2010, Cold Spring Harbor Perspectives Biol., pp. 1-10.
Ge et al, "A tissue culture system for different germplasms of indica rice", Plant Cell Rep, Jan. 24, 2006, pp. 392-402, vol. 25, Springer-Verlag.
Guo et al, "Directed evolution of an enhanced and highly efficient FokI cleavage domain for Zinc Finger Nucleases", JMol Biol, Jul. 2, 2010, pp. 96-107, vol. 400, No. 1.
Hendel et al, "Chemically modified guide RNAs enhance CRISPR-Cas genome editing in human primary cells", Nat Biotechnol., Sep. 2015, pp. 985-989, vol. 33, No. 9.
Jores et al, "Characterization of the targeting signal in mitochondrial b-barrel proteins", Nature Comm., Jun. 27, 2016, pp. e12036, 16 pages, vol. 7.
Komorl et al, "Programmable editing of a target base in genomic DNA without double-stranded DNA cleavage", Nature, Oct. 20, 2016, pp. 420-424, vol. 533, No. 7603.
Laurie et al., "A Novel Technique for the Partial Isolation of Maize Embryo Sacs and Subsequent Regeneration of Plants", In Vitro Cell. Dev. Biol., pp. 320-325, vol. 35, Society for In Vitro Biology.
LeCong et al, "Multiplex Genome Engineering Using CRISPR/Cas Systems", Science, Feb. 15, 2013, pp. 819-823, vol. 339, No. 6121.
Liu et al, "C2c1-sgRNA Complex Structure Reveals RNA-Guided DNA Cleavage Mechanism", Molecular Cell, Jan. 19, 2017, pp. 310-322, vol. 65, Elsevier Inc.
Mahfouz et al, "De novo-engineered transcription activator-like effector (TALE) hybrid nuclease with novel DNA binding specificity creates double-strandbreaks", PNAS, Feb. 8, 2011, pp. 2623-2628, vol. 108, No. 6.
Mahfouz et al, "TALE nucleases and next generation GM Crops", GM Crops, Jun. 2011, pp. 99-103, vol. 2, No. 2, Landes Bioscience.
Marand et al, "Towards genome-wide prediction and characterization of enhancers in plants", Biochim Biophys Acta Gene Regul Mech., 2017, pp. 131-139, vol. 1860, vol. 1.

Martin-Ortigosa et al, "Mesoporous Silica Nanoparticle-Mediated Intracellular Cre Protein Delivery for Maize Genome Editing via loxP Site Excision", Plant Physiology, Feb. 2014, pp. 537-547, vol. 164, American Society of Plant Biologists.
Niu et al, "Transient Expression Assays for Quantifying Signaling Output", Methods Mol. Biol., 2012, Chapter 16, pp. 195-206, vol. 876.
Office Action for U.S. Appl. No. 16/146,871 dated Mar. 20, 2020.
Office Action for U.S. Appl. No. 16/16261243 dated Jun. 26, 2020.
Ran et al, "Double nicking by RNA-guided CRISPR Cas9 for enhanced genome editing specificity", Cell, Sep. 12, 2013, pp. 1380-1389, vol. 154, No. 6.
Ran et al, "Genome engineering using the CRISPR-Cas 9 system", Nat Protoc., Nov. 2013, pp. 2281-2308, vol. 8, No. 11.
Ravi et al, "A haploid genetics toolbox for *Arabidopsis thaliana*", Nature Communications, Oct. 31, 2014, pp. 1-8, Macmillan Publishers Limited.
Senapati, S.K., "A Review on Research Progress on in vitro Regeneration and Transformation of Tomato", Annual Research & Review in Biology, Mar. 4, 2016, pp. 1-9, vol. 9, No. 6.
Shmakov et al, "Discovery and functional characterization of diverse Class 2 CRISPR-Cas systems", Mol. Cell., Nov. 5, 2015, pp. 385-397, vol. 60, No. 3.
Sticklen et al, "Shoot Apical Meristem: A Sustainable Explant for Genetic Transformation of Cereal Crops", In Vitro Cell. Dev. Biol.—Plant, May-Jun. 2005, pp. 187-200, vol. 41, Society for In Vitro Biology.
Suay et al, "Specific roles of 5' RNA secondary structures in stabilizing transcripts in chloroplasts", Nucleic Acids Research, Jul. 22, 2005, pp. 4754-4761, vol. 33, No. 15, Oxford University Press.
Tahir et al, "Genetic Transformation Protocols Using Zygotic Embryos as Explants: An Overview", Methods in Molecular Biology, Chapter 21, 2011, pp. 309-326, vol. 710, Springer Science+Business Media, LLC.
Urnov et al, "Genome editing with engineered zinc finger nucleases", Nature Rev. Genet., Sep. 2010, pp. 636-646, vol. 11, Macmillan Publishers Limited.
Vinoth et al, "Optimization of Factors Influencing Microinjection Method for Agrobacterium tumefaciens—Mediated Transformation of Tomato", Appl Biochem Biotechnol, Jan. 10, 2013, pp. 1173-1187, vol. 169.
Yang et al, "PAM-Dependent Target DNA Recognition and Cleavage by C2c1 CRISPR-Cas Endonuclease", Cell, Dec. 15, 2016, pp. 1814-1828, vol. 167, Elsevier Inc.
Zefu et al, "Combining ATAC-seq with nuclei sorting for discovery of cis-regulatory regions in plant genomes", Nucleic Acids Research, 2017, pp. e41, vol. 45, No. 6, Oxford University Press.
Zetschte et al, "Cpf1 Is a Single RNA-Guided Endonuclease of a Class 2 CRISPR-Cas System" Oct. 22, 2015, Cell, pp. 759-771, vol. 163, Elsevier Inc.
Zhang et al, "Genetic transformation of commercial cultivars of oat (*Avena sativa* L.) and barley (*Hordeum vulgare* L.) using in vitro shoot meristematic cultures derived from germinated seedlings", Plant Cell Reports, Jan. 14, 1999, pp. 959-966, vol. 18, Springer-Verlag.
Wang et al, "Simultaneous Editing of Three Homoeoalleles in Hexaploid in Hexaploid Bread Wheat Confers Heritable Resistance To Powdery Mildew", Nature Biotechnology, Sep. 2014, pp. 947-952, vol. 32, No. 9.
Zhang, et al, "Efficient and Transgene-Free Genome Editing in Wheat Through Transient Expression of CRISPR/Cas9 DNA or RNA", Nature Communication, 7:12617, Aug. 25, 2016, pp. 1-8.
United States Patent and Trademark Office, "Final Office Action", issued in connection to U.S. Appl. No. 16/261,243, 36 pages, dated Feb. 4, 2021.
Collonnier, Cécile, et al., "Towards mastering CRISP-induced gene knock-in in plants: Survey of key features and focus on the model Physcomitrella patens", Methods., vol. 121-122, pp. 103-117, 2017.
Jeong, Namhee, et al., "Ln Is a Key Regulator of Leaflet Shape and Number of Seeds per Pod in Soybean", The Plant Cell, vol. 24, pp. 4807-4818, 2012.

(56) References Cited

OTHER PUBLICATIONS

United States Patent and Trademark Office, "Final Office Action", Issued in connection to U.S. Appl. No. 16/261,233, dated Feb. 10, 2021, 35 pages.
United States Patent and Trademark Office, "Office Action—Requirement for Unity of Invention", Issued in connection to U.S. Appl. No. 16/480,992, dated Jul. 25, 2019, 16 pages.
Schmutz, Jeremy, et al., "Genome sequence of the palaeopolyploid soybean", Nature, vol. 463, pp. 178-183, 2010.
Schaeffer, Scott M., et al., "CRISPR/Cas9-mediated genome editing and gene replacement in plants: Transitioning from lab to field", Plant Science, vol. 240, pp. 130-142, 2015.
Intellectual Property Office of Singapore, "Second Written Opinion" in connection with Application No. 11201906795S, Application Filing Date Jan. 29, 2018, Date of Second Written Opinion dated Apr. 22, 2021, 8 pages, 2021.
Gil-Humanes et al., "High-efficiency gene targeting in hexaploid wheat using DNA replicons and CRISPR/Cas9", The Plant Journal, vol. 89, pp. 1251-1262, 2017.
Weinthal et al., "Plant Genome Editing and its Applications in Cereals", IntechOpen, DOI: 10.5772/66818, 15 pages, Dec. 14, 2016.
Lieber, Michael R., "The Mechanism of Double-Strand DNA Break Repair by the Nonhomologous DNA End Joining Pathway", Annu Rev Biochem., doi:10.1146/annurev.biochem.052308.093131, vol. 79, pp. 181-211, 2010.
Richardson et al., "Enhancing homology-directed genome editing by catalytically active and inactive CRISPR-Cas9 using asymmetric donor DNA", Nature Biotechnology, vol. 34, No. 3, pp. 339-345, Mar. 2016.
United States Patent and Trademark Office in connection with U.S. Appl. No. 16/480,992, filed Jul. 25, 2019, "Non-Final Office Action", 48 pages, dated Jul. 6, 2021.
United States Patent and Trademark Office in connection with U.S. Appl. No. 16/480,992, filed Jul. 25, 2019, "Final Office Action", 29 pages, dated Jan. 7, 2022.
Zhang et al., "The CRISPR/Cas9 system produces specific and homozygous targeted gene editing in rice in one generation", Plant Biotechnology Journal, vol. 12, pp. 797-807, 2014.
Que et al, "The Frequency and Degree of Cosuppression by Sense Chalcone Synthase Transgenes Are Dependent on Transgene Promoter Strength and Are Reduced by Premature Nonsense Codons in the Transgene Coding Sequence," The Plant Cell, vol. 9, Aug. 1997, pp. 1357-1368.
Shlyueva et al., "Transcriptional enhancers: from properties to genome-wide predictions," Nature Reviews Genetics, vol. 15, Apr. 2014, pp. 272-286.
Weber et al., "Plant Enhancers: A Call for Discovery," Trends in Plant Science, vol. 21, No. 11, Nov. 2016, pp. 974-987.

\* cited by examiner

Figure 1A

```
NCBI_gi_22123_230        ACTATGCGATTGCTTTCCTGGACCCGTGCAGCTGCGGTGGCATGGGAGGC
CONTIG_230_p1-62.1%      ACTATGCGATTGCTTTCCTGGACCCGTGCAGCTGCGGTGGCATGGGAGGC
CONTIG_229_p2-7.43%      ACTATGCGATTGCTTTCCTGGACCCGTGCAGCTGCGGTGGCATGGGAGGC
CONTIG_228_p3-3.91%      ACTATGCGATTGCTTTCCTGGACCCGTGCAGCTGCGGTGGCATGGGAGGC
CONTIG_229_p4-3.9%       ACTATGCGATTGCTTTCCTGGACCCGTGCAGCTGCGGTGGCATGGGAGGC
CONTIG_227_p5-3.63%      ACTATGCGATTGCTTTCCTGGACCCGTGCAGCTGCGGTGGCATGGGAGGC
CONTIG_226_p6-3.32%      ACTATGCGATTGCTTTCCTGGACCCGTGCAGCTGCGGTGGCATGGGAGGC
CONTIG_225_p7-2.93%      ACTATGCGATTGCTTTCCTGGACCCGTGCAGCTGCGGTGGCATGGGAGGC
CONTIG_224_p8-2.68%      ACTATGCGATTGCTTTCCTGGACCCGTGCAGCTGCGGTGGCATGGGAGGC
CONTIG_231_p9-2.57%      ACTATGCGATTGCTTTCCTGGACCCGTGCAGCTGCGGTGGCATGGGAGGC
CONTIG_231_p10-1.01%     ACTATGCGATTGCTTTCCTGGACCCGTGCAGCTGCGGTGGCATGGGAGGC
CONTIG_224_p11-0.87%     ACTATGCGATTGCTTTCCTGGACCCGTGCAGCTGCGGTGGCATGGGAGGC
CONTIG_227_p12-0.65%     ACTATGCGATTGCTTTCCTGGACCCGTGCAGCTGCGGTGGCATGGGAGGC
CONTIG_222_p13-0.55%     ACTATGCGATTGCTTTCCTGGACCCGTGCAGCTGCGGTGGCATGGGAGGC
CONTIG_226_p14-0.51%     ACTATGCGATTGCTTTCCTGGACCCGTGCAGCTGCGGTGGCATGGGAGGC
CONTIG_223_p15-0.5%      ACTATGCGATTGCTTTCCTGGACCCGTGCAGCTGCGGTGGCATGGGAGGC
CONTIG_220_p16-0.36%     ACTATGCGATTGCTTTCCTGGACCCGTGCAGCTGCGGTGGCATGGGAGGC
CONTIG_229_p17-0.33%     -ATATGCGATTGCTTTCCTGGACCCGTGCAGCTGCGGTGGCATGGGAGGC
CONTIG_228_p18-0.32%     ACTATGCGATTGCTTTCCTGGACCCGTGCAGCTGCGGTGGCATGGGAGGC
CONTIG_231_p19-0.31%     ACTATGCGATTGCTTTCCTGGACCCGTGCAGCTGCGGTGGCATGGGAGGC
CONTIG_221_p20-0.28%     ACTATGCGATTGCTTTCCTGGACCCGTGCAGCTGCGGTGGCATGGGAGGC
CONTIG_229_p21-0.27%     ACTATGCGATTGCTTTCCTGGACCCGTGCAGCTGCGGTGGCATGGGAGGC
CONTIG_221_p22-0.22%     ACTATGCGATTGCTTTCCTGGACCCGTGCAGCTGCGGTGGCATGGGAGGC
CONTIG_227_p23-0.22%     ACTATGCGATTGCTTTCCTGGACCCGTGCAGCTGCGGTGGCATGGGAGGC
CONTIG_228_p24-0.21%     ACTATGCGATTGCTTTCCTGGACCCGTGCAGCTGCGGTGGCATGGGAGGC
CONTIG_225_p25-0.21%     ACTATGCGATTGCTTTCCTGGACCCGTGCAGCTGCGGTGGCATGGGAGGC
CONTIG_237_p26-0.2%      ACTATGCGATTGCTTTCCTGGACCCGTGCAGCTGCGGTGGCATGGGAGGC
CONTIG_263_p27-0.19%     ACTATGCGATTGCTTTCCTGGACCCGTGCAGCTGCGGTGGCATGGGAGGC
CONTIG_221_p28-0.18%     ACTATGCGATTGCTTTCCTGGACCCGTGCAGCTGCGGTGGCATGGGAGGC
                          *************************************************

NCBI_gi_22123_230        CGGCAAGCCACTGTCGATCGAGGAGGTGGAGGTAGCGCCTCCGCAGGCCA
CONTIG_230_p1-62.1%      CGGCAAGCCACTGTCGATCGAGGAGGTGGAGGTAGCGCCTCCGCAGGCCA
CONTIG_229_p2-7.43%      CGGCAAGCCACTGTCGATCGAGGAGGTGGAGGTAGCGCCTCCGCAGGCCA
CONTIG_228_p3-3.91%      CGGCAAGCCACTGTCGATCGAGGAGGTGGAGGTAGCGCCTCCGCAGGCCA
CONTIG_229_p4-3.9%       CGGCAAGCCACTGTCGATCGAGGAGGTGGAGGTAGCGCCTCCGCAGGCCA
CONTIG_227_p5-3.63%      CGGCAAGCCACTGTCGATCGAGGAGGTGGAGGTAGCGCCTCCGCAGGCCA
CONTIG_226_p6-3.32%      CGGCAAGCCACTGTCGATCGAGGAGGTGGAGGTAGCGCCTCCGCAGGCCA
CONTIG_225_p7-2.93%      CGGCAAGCCACTGTCGATCGAGGAGGTGGAGGTAGCGCCTCCGCAGGCCA
CONTIG_224_p8-2.68%      CGGCAAGCCACTGTCGATCGAGGAGGTGGAGGTAGCGCCTCCGCAGGCCA
CONTIG_231_p9-2.57%      CGGCAAGCCACTGTCGATCGAGGAGGTGGAGGTAGCGCCTCCGCAGGCCA
CONTIG_231_p10-1.01%     CGGCAAGCCACTGTCGATCGAGGAGGTGGAGGTAGCGCCTCCGCAGGCCA
CONTIG_224_p11-0.87%     CGGCAAGCCACTGTCGATCGAGGAGGTGGAGGTAGCGCCTCCGCAGGCCA
CONTIG_227_p12-0.65%     CGGCAAGCCACTGTCGATCGAGGAGGTGGAGGTAGCGCCTCCGCAGGCCA
CONTIG_222_p13-0.55%     CGGCAAGCCACTGTCGATCGAGGAGGTGGAGGTAGCGCCTCCGCAGGCCA
CONTIG_226_p14-0.51%     CGGCAAGCCACTGTCGATCGAGGAGGTGGAGGTAGCGCCTCCGCAGGCCA
CONTIG_223_p15-0.5%      CGGCAAGCCACTGTCGATCGAGGAGGTGGAGGTAGCGCCTCCGCAGGCCA
CONTIG_220_p16-0.36%     CGGCAAGCCACTGTCGATCGAGGAGGTGGAGGTAGCGCCTCCGCAGGCCA
CONTIG_229_p17-0.33%     CGGCAAGCCACTGTCGATCGAGGAGGTGGAGGTAGCGCCTCCGCAGGCCA
CONTIG_228_p18-0.32%     CGGCAAGCCACTGTCGATCGAGGAGGTGGAGGTAGCGCCTCCGCAGGCCA
CONTIG_231_p19-0.31%     CGGCAAGCCACTGTCGATCGAGGAGGTGGAGGTAGCGCCTCCGCAGGCCA
CONTIG_221_p20-0.28%     CGGCAAGCCACTGTCGATCGAGGAGGTGGAGGTAGCGCCTCCGCAGGCCA
CONTIG_229_p21-0.27%     CGGCAAGCCACTGTCGATCGAGGAGGTGGAGGTAGCGCCTCCGCAGGCCA
CONTIG_221_p22-0.22%     CGGCAAGCCACTGTCGATCGAGGAGGTGGAGGTAGCGCCTCCGCAGGCCA
CONTIG_227_p23-0.22%     CGGCAAGCCACTGTCGATCGAGGAGGTGGAGGTAGCGCCTCCGCAGGCCA
CONTIG_228_p24-0.21%     CGGCAAGCCACTGTCGATCGAGGAGGTGGAGGTAGCGCCTCCGCAGGCCA
CONTIG_225_p25-0.21%     CGGCAAGCCACTGTCGATCGAGGAGGTGGAGGTAGCGCCTCCGCAGGCCA
CONTIG_237_p26-0.2%      CGGCAAGCCACTGTCGATCGAGGAGGTGGAGGTAGCGCCTCCGCAGGCCA
CONTIG_263_p27-0.19%     CGGCAAGCCACTGTCGATCGAGGAGGTGGAGGTAGCGCCTCCGCAGGCCA
CONTIG_221_p28-0.18%     CGGCAAGCCACTGTCGATCGAGGAGGTGGAGGTAGCGCCTCCGCAGGCCA
                          *************************************************
```

Figure 1B

```
NCBI_gi_22123_230      TGGAGGTGCGCGTCAAGATCCTCTTCACCTCGCTCTGCCACACCGACGT-
CONTIG_230_p1-62.1%    TGGAGGTGCGCGTCAAGATCCTCTTCACCTCGCTCTGCCACACCGACGT-
CONTIG_229_p2-7.43%    TGGAGGTGCGCGTCAAGATCCTCTTCACCTCGCTCTGCCACACCGACG--
CONTIG_228_p3-3.91%    TGGAGGTGCGCGTCAAGATCCTCTTCACCTCGCTCTGCCACACCGACG--
CONTIG_229_p4-3.9%     TGGAGGTGCGCGTCAAGATCCTCTTCACCTCGCTCTGCCACACCGACT--
CONTIG_227_p5-3.63%    TGGAGGTGCGCGTCAAGATCCTCTTCACCTCGCTCTGCCACACCGACG--
CONTIG_226_p6-3.32%    TGGAGGTGCGCGTCAAGATCCTCTTCACCTCGCTCTGCCACACCGACG--
CONTIG_225_p7-2.93%    TGGAGGTGCGCGTCAAGATCCTCTTCACCTCGCTCTGCCACACCGACG--
CONTIG_224_p8-2.68%    TGGAGGTGCGCGTCAAGATCCTCTTCACCTCGCTCTGCCACACCGACG--
CONTIG_231_p9-2.57%    TGGAGGTGCGCGTCAAGATCCTCTTCACCTCGCTCTGCCACACCGACGTT
CONTIG_231_p10-1.01%   TGGAGGTGCGCGTCAAGATCCTCTTCACCTCGCTCTGCCACACCGACGCT
CONTIG_224_p11-0.87%   TGGAGGTGCGCGTCAAGATCCTCTTCACCTCGCTCTGCCACACCGAC---
CONTIG_227_p12-0.65%   TGGAGGTGCGCGTCAAGATCCTCTTCACCTCGCTCTGCCACACCGAC---
CONTIG_222_p13-0.55%   TGGAGGTGCGCGTCAAGATCCTCTTCACCTCGCTCTGCCACACCGACG--
CONTIG_226_p14-0.51%   TGGAGGTGCGCGTCAAGATCCTCTTCACCTCGCTCTGCCACACCGAC---
CONTIG_223_p15-0.5%    TGGAGGTGCGCGTCAAGATCCTCTTCACCTCGCTCTGCCACACCGACG--
CONTIG_220_p16-0.36%   TGGAGGTGCGCGTCAAGATCCTCTTCACCTCGCTCTGCCACACCGAC---
CONTIG_229_p17-0.33%   TGGAGGTGCGCGTCAAGATCCTCTTCACCTCGCTCTGCCACACCGACGT-
CONTIG_228_p18-0.32%   TGGAGGTGCGCGTCAAGATCCTCTTCACCTCGCTCTGCCACACCGACC--
CONTIG_231_p19-0.31%   TGGAGGTGCGCGTCAAGATCCTCTTCACCTCGCTCTGCCACACCGACGAT
CONTIG_221_p20-0.28%   TGGAGGTGCGCGTCAAGATCCTCTTCACCTCGCTCTGCCACACCGAC---
CONTIG_229_p21-0.27%   TGGAGGTGCGCGTCAAGATCCTCTTCACCTCGCTCTGCCACACCGACGT-
CONTIG_221_p22-0.22%   TGGAGGTGCGCGTCAAGATCCTCTTCACCTCGCTCTGCCACACCGACG--
CONTIG_227_p23-0.22%   TGGAGGTGCGCGTCAAGATCCTCTTCACCTCGCTCTGCCACACCGACGT-
CONTIG_228_p24-0.21%   TGGAGGTGCGCGTCAAGATCCTCTTCACCTCGCTCTGCCACACCGAT---
CONTIG_225_p25-0.21%   TGGAGGTGCGCGTCAAGATCCTCTTCACCTCGCTCTGCCACACCGAC---
CONTIG_237_p26-0.2%    TGGAGGTGCGCGTCAAGATCCTCTTCACCTCGCTCTGCCACACCGACGTT
CONTIG_263_p27-0.19%   TGGAGGTGCGCGTCAAGATCCTCTTCACCTCGCTCTGCCACACCGACGGA
CONTIG_221_p28-0.18%   TGGAGGTGCGCGTCAAGATCCTCTTCACCTCGCTCTGCCACACCG-----
                       **************************************************

NCBI_gi_22123_230      --------------------CT--------ACT----TCTG-----GGAGGCCAA
CONTIG_230_p1-62.1%    --------------------CT--------ACT----TCTG-----GGAGGCCAA
CONTIG_229_p2-7.43%    --------------------CT--------ACT----TCTG-----GGAGGCCAA
CONTIG_228_p3-3.91%    ---------------------T--------ACT----TCTG-----GGAGGCCAA
CONTIG_229_p4-3.9%     --------------------CT--------ACT----TCTG-----GGAGGCCAA
CONTIG_227_p5-3.63%    ------------------------------ACT----TCTG-----GGAGGCCAA
CONTIG_226_p6-3.32%    --------------------------CT----TCTG-----GGAGGCCAA
CONTIG_225_p7-2.93%    ---------------------------T----TCTG-----GGAGGCCAA
CONTIG_224_p8-2.68%    --------------------------------TCTG-----GGAGGCCAA
CONTIG_231_p9-2.57%    --------------------CT--------ACT----TCTG-----GGAGGCCAA
CONTIG_231_p10-1.01%   --------------------CT--------ACT----TCTG-----GGAGGCCAA
CONTIG_224_p11-0.87%   ---------------------T----TCTG-----GGAGGCCAA
CONTIG_227_p12-0.65%   ---------------------T--------ACT----TCTG-----GGAGGCCAA
CONTIG_222_p13-0.55%   ------------------------------TG-----GGAGGCCAA
CONTIG_226_p14-0.51%   ------------------------------ACT----TCTG-----GGAGGCCAA
CONTIG_223_p15-0.5%    -------------------------------CTG----GGAGGCCAA
CONTIG_220_p16-0.36%   --------------------------------G-----GGAGGCCAA
CONTIG_229_p17-0.33%   --------------------CT--------ACT----TCTG-----GGAGGCCAA
CONTIG_228_p18-0.32%   ---------------------T--------ACT----TCTG-----GGAGGCCAA
CONTIG_231_p19-0.31%   --------------------CT--------ACT----TCTG-----GGAGGCCAA
CONTIG_221_p20-0.28%   ------------------------------TG-----GGAGGCCAA
CONTIG_229_p21-0.27%   ---------------------T--------ACT----TCTG-----GGAGGCCAA
CONTIG_221_p22-0.22%   --------------------------------G-----GGAGGCCAA
CONTIG_227_p23-0.22%   --------------------------CT-----TCTG-----GGAGGCCAA
CONTIG_228_p24-0.21%   --------------------CT--------ACT----TCTG-----GGAGGCCAA
CONTIG_225_p25-0.21%   --------------------------CT-----TCTG-----GGAGGCCAA
CONTIG_237_p26-0.2%    TTTTTT--------------CT--------ACT----TCTG-----GGAGGCCAA
CONTIG_263_p27-0.19%   AGAAAACCTGATGGAGTCTGCAAAAGACCTGAGACTGGAGGGAGGCCAA
CONTIG_221_p28-0.18%   ----------------------------------TCTG-----GGAGGCCAA
                                              *         ********
```

Figure 1C

```
NCBI_gi_22123_230      GGTATCTAATCAGCCATCCCATTTGTGATCTTTGTCAGTAGATATGATAC
CONTIG_230_p1-62.1%    GGTATCTAATCAGCCATCCCATTTGTGATCTTTGTCAGTAGATATGATAC
CONTIG_229_p2-7.43%    GGTATCTAATCAGCCATCCCATTTGTGATCTTTGTCAGTAGATATGATAC
CONTIG_228_p3-3.91%    GGTATCTAATCAGCCATCCCATTTGTGATCTTTGTCAGTAGATATGATAC
CONTIG_229_p4-3.9%     GGTATCTAATCAGCCATCCCATTTGTGATCTTTGTCAGTAGATATGATAC
CONTIG_227_p5-3.63%    GGTATCTAATCAGCCATCCCATTTGTGATCTTTGTCAGTAGATATGATAC
CONTIG_226_p6-3.32%    GGTATCTAATCAGCCATCCCATTTGTGATCTTTGTCAGTAGATATGATAC
CONTIG_225_p7-2.93%    GGTATCTAATCAGCCATCCCATTTGTGATCTTTGTCAGTAGATATGATAC
CONTIG_224_p8-2.68%    GGTATCTAATCAGCCATCCCATTTGTGATCTTTGTCAGTAGATATGATAC
CONTIG_231_p9-2.57%    GGTATCTAATCAGCCATCCCATTTGTGATCTTTGTCAGTAGATATGATAC
CONTIG_231_p10-1.01%   GGTATCTAATCAGCCATCCCATTTGTGATCTTTGTCAGTAGATATGATAC
CONTIG_224_p11-0.87%   GGTATCTAATCAGCCATCCCATTTGTGATCTTTGTCAGTAGATATGATAC
CONTIG_227_p12-0.65%   GGTATCTAATCAGCCATCCCATTTGTGATCTTTGTCAGTAGATATGATAC
CONTIG_222_p13-0.55%   GGTATCTAATCAGCCATCCCATTTGTGATCTTTGTCAGTAGATATGATAC
CONTIG_226_p14-0.51%   GGTATCTAATCAGCCATCCCATTTGTGATCTTTGTCAGTAGATATGATAC
CONTIG_223_p15-0.5%    GGTATCTAATCAGCCATCCCATTTGTGATCTTTGTCAGTAGATATGATAC
CONTIG_220_p16-0.36%   GGTATCTAATCAGCCATCCCATTTGTGATCTTTGTCAGTAGATATGATAC
CONTIG_229_p17-0.33%   GGTATCTAATCAGCCATCCCATTTGTGATCTTTGTCAGTAGATATGATAC
CONTIG_228_p18-0.32%   GGTATCTAATCAGCCATCCCATTTGTGATCTTTGTCAGTAGATATGATAC
CONTIG_231_p19-0.31%   GGTATCTAATCAGCCATCCCATTTGTGATCTTTGTCAGTAGATATGATAC
CONTIG_221_p20-0.28%   GGTATCTAATCAGCCATCCCATTTGTGATCTTTGTCAGTAGATATGATAC
CONTIG_229_p21-0.27%   GGTATCTAATCAGCCATCCCATTTGTGATCTTTGTCAGTAGATATGATAC
CONTIG_221_p22-0.22%   GGTATCTAATCAGCCATCCCATTTGTGATCTTTGTCAGTAGATATGATAC
CONTIG_227_p23-0.22%   GGTATCTAATCAGCCATCCCATTTGTGATCTTTGTCAGTAGATATGATAC
CONTIG_228_p24-0.21%   GGTATCTAATCAGCCATCCCATTTGTGATCTTTGTCAGTAGATATGATAC
CONTIG_225_p25-0.21%   GGTATCTAATCAGCCATCCCATTTGTGATCTTTGTCAGTAGATATGATAC
CONTIG_237_p26-0.2%    GGTATCTAATCAGCCATCCCATTTGTGATCTTTGTCAGTAGATATGATAC
CONTIG_263_p27-0.19%   GGTATCTAATCAGCCATCCCATTTGTGATCTTTGTCAGTAGATATGATAC
CONTIG_221_p28-0.18%   GGTATCTAATCAGCCATCCCATTTGTGATCTTTGTCAGTAGATATGATAC
                       **************************************************

NCBI_gi_22123_230      AACAACTCGCGGT   (SEQ ID NO:47)
CONTIG_230_p1-62.1%    AACAACTCGCGGT   (SEQ ID NO:48)
CONTIG_229_p2-7.43%    AACAACTCGCGGT   (SEQ ID NO:49)
CONTIG_228_p3-3.91%    AACAACTCGCGGT   (SEQ ID NO:50)
CONTIG_229_p4-3.9%     AACAACTCGCGGT   (SEQ ID NO:51)
CONTIG_227_p5-3.63%    AACAACTCGCGGT   (SEQ ID NO:52)
CONTIG_226_p6-3.32%    AACAACTCGCGGT   (SEQ ID NO:53)
CONTIG_225_p7-2.93%    AACAACTCGCGGT   (SEQ ID NO:54)
CONTIG_224_p8-2.68%    AACAACTCGCGGT   (SEQ ID NO:55)
CONTIG_231_p9-2.57%    AACAACTCGCGGT   (SEQ ID NO:56)
CONTIG_231_p10-1.01%   AACAACTCGCGGT   (SEQ ID NO:57)
CONTIG_224_p11-0.87%   AACAACTCGCGGT   (SEQ ID NO:58)
CONTIG_227_p12-0.65%   AACAACTCGCGGT   (SEQ ID NO:59)
CONTIG_222_p13-0.55%   AACAACTCGCGGT   (SEQ ID NO:60)
CONTIG_226_p14-0.51%   AACAACTCGCGGT   (SEQ ID NO:61)
CONTIG_223_p15-0.5%    AACAACTCGCGGT   (SEQ ID NO:62)
CONTIG_220_p16-0.36%   AACAACTCGCGGT   (SEQ ID NO:63)
CONTIG_229_p17-0.33%   AACAACTCGCGGT   (SEQ ID NO:64)
CONTIG_228_p18-0.32%   AACAACTCGCGGT   (SEQ ID NO:65)
CONTIG_231_p19-0.31%   AACAACTCGCGGT   (SEQ ID NO:66)
CONTIG_221_p20-0.28%   AACAACTCGCGGT   (SEQ ID NO:67)
CONTIG_229_p21-0.27%   AACAACTCGCGGT   (SEQ ID NO:68)
CONTIG_221_p22-0.22%   AACAACTCGCGGT   (SEQ ID NO:69)
CONTIG_227_p23-0.22%   AACAACTCGCGGT   (SEQ ID NO:70)
CONTIG_228_p24-0.21%   AACAACTCGCGGT   (SEQ ID NO:71)
CONTIG_225_p25-0.21%   AACAACTCGCGGT   (SEQ ID NO:72)
CONTIG_237_p26-0.2%    AACAACTCGCGGT   (SEQ ID NO:73)
CONTIG_263_p27-0.19%   AACAACTCGCGGT   (SEQ ID NO:74)
CONTIG_221_p28-0.18%   AACAACTCGCGGT   (SEQ ID NO:75)
```

Figure 2A

```
NCBI_gi_22123_230        TGGAGGTGCGCGTCAAGATCCTCTTCACCTCGCTCTGCCACACCGACG--
CONTIG_230_p1_76.03%     TGGAGGTGCGCGTCAAGATCCTCTTCACCTCGCTCTGCCACACCGACG--
CONTIG_264_p2_4.18%      TGGAGGTGCGCGTCAAGATCCTCTTCACCTCGCTCTGCCACACCGACGA-
CONTIG_231_p3_1.21%      TGGAGGTGCGCGTCAAGATCCTCTTCACCTCGCTCTGCCACACCGACGT-
CONTIG_292_p4_1.2%       TGGAGGTGCGCGTCAAGATCCTCTTCACCTCGCTCTGCCACACCGNNNNN
CONTIG_262_p5_1%         TGGAGGTGCGCGTCAAGATCCTCTTCACCTCGCTCTGCCACACCGACGT-
CONTIG_229_p6_0.93%      TGGAGGTGCGCGTCAAGATCCTCTTCACCTCGCTCTGCCACACCGACG--
CONTIG_262_p7_0.92%      TGGAGGTGCGCGTCAAGATCCTCTTCACCTCGCTCTGCCACACCGACGA-
CONTIG_292_p8_0.92%      TGGAGGTGCGCGTCAAGATCCTCTTCACCTCGCTCTGCCACACCGNNNNN
CONTIG_225_p9_0.91%      TGGAGGTGCGCGTCAAGATCCTCTTCACCTCGCTCTGCCACACCGACGT-
CONTIG_292_p10_0.8%      TGGAGGTGCGCGTCAAGATCCTCTTCACCTCGCTCTGCCACACCGNNNNN
CONTIG_292_p11_0.74%     TGGAGGTGCGCGTCAAGATCCTCTTCACCTCGCTCTGCCACACCGNNNNN
CONTIG_292_p12_0.73%     TGGAGGTGCGCGTCAAGATCCTCTTCACCTCGCTCTGCCACACCGNNNNN
CONTIG_224_p13_0.63%     TGGAGGTGCGCGTCAAGATCCTCTTCACCTCGCTCTGCCACACCGA----
CONTIG_227_p14_0.62%     TGGAGGTGCGCGTCAAGATCCTCTTCACCTCGCTCTGCCACACCGACG--
CONTIG_231_p15_0.61%     TGGAGGTGCGCGTCAAGATCCTCTTCACCTCGCTCTGCCACACCGACGC-
CONTIG_292_p16_0.61%     TGGAGGTGCGCGTCAAGATCCTCTTCACCTCGCTCTGCCACACCGNNNNN
CONTIG_292_p17_0.6%      TGGAGGTGCGCGTCAAGATCCTCTTCACCTCGCTCTGCCACACCGNNNNN
CONTIG_292_p18_0.58%     TGGAGGTGCGCGTCAAGATCCTCTTCACCTCGCTCTGCCACACCGNNNNN
CONTIG_229_p19_0.54%     TGGAGGTGCGCGTCAAGATCCTCTTCACCTCGCTCTGCCACACCGAC---
CONTIG_260_p20_0.54%     TGGAGGTGCGCGTCAAGATCCTCTTCACCTCGCTCTGCCACACCGACGG-
CONTIG_259_p21_0.52%     TGGAGGTGCGCGTCAAGATCCTCTTCACCTCGCTCTGCCACACCGACGA-
CONTIG_258_p22_0.5%      TGGAGGTGCGCGTCAAGATCCTCTTCACCTCGCTCTGCCACACCGACGG-
CONTIG_261_p23_0.46%     TGGAGGTGCGCGTCAAGATCCTCTTCACCTCGCTCTGCCACACCGATA--
CONTIG_243_p24_0.42%     TGGAGGTGCGCGTCAAGATCCTCTTCACCTACC-----------------
CONTIG_221_p25_0.41%     TGGAGGTGCGCGTCAAGATCCTCTTCACCTCGCTCTGCCACACCGAC---
CONTIG_237_p26_0.36%     TGGAGGTGCGCGTCAAGATCCTCTTCACCTCGCTCTGCCACACCGACGG-
CONTIG_292_p27_0.36%     TGGAGGTGCGCGTCAAGATCCTCTTCACCTCGCTCTGCCACACCGNNNNN
CONTIG_263_p28_0.32%     TGGAGGTGCGCGTCAAGATCCTCTTCACCTCGCTCTGCCACACCGACGG-
CONTIG_227_p29_0.32%     TGGAGGTGCGCGTCAAGATCCTCTTCACCTCGCTCTGCCACACCGAC---
CONTIG_264_p30_0.32%     TGGAGGTGCGCGTCAAGATCCTCTTCACCTCGCTCTGCCACACCGACGA-
CONTIG_226_p31_0.32%     TGGAGGTGCGCGTCAAGATCCTCTTCACCTCGCTCTGCCACACCGAC---
CONTIG_264_p32_0.31%     TGGAGGTGCGCGTCAAGATCCTCTTCACCTCGCTCTGCCACACCGACGGT
CONTIG_292_p33_0.3%      TGGAGGTGCGCGTCAAGATCCTCTTCACCTCGCTCTGCCACACCGNNNNN
CONTIG_292_p34_0.3%      TGGAGGTGCGCGTCAAGATCCTCTTCACCTCGCTCTGCCACACCGNNNNN
CONTIG_229_p35_0.27%     TGGAGGTGCGCGTCAAGATCCTCTTCACCTCGCTCTGCCACACCGACG--
                         ************************** *
```

Figure 2B

```
NCBI_gi_22123_230       ----------------------------------------------------
CONTIG_230_p1_76.03%    ----------------------------------------------------
CONTIG_264_p2_4.18%     -------------------------------TACCGTT--ATT
CONTIG_231_p3_1.21%     ----------------------------------------------------
CONTIG_292_p4_1.2%      ----------GA-GTTGTCATATGTTAATAACGGTATG-TTTAATTGAGTT
CONTIG_262_p5_1%        ---------------------------------------TTAATTGAGTT
CONTIG_229_p6_0.93%     ----------------------------------------------------
CONTIG_262_p7_0.92%     -------------------------------TACCGTT--ATT
CONTIG_292_p8_0.92%     --T-------GA-GTTGTCATATGTTAATAACGGTATG--TTAATTGAGTT
CONTIG_225_p9_0.91%     ----------------------------------------------------
CONTIG_292_p10_0.8%     --T---------ATTAACATATGACAACTCAATTAAACTACCGTT--ATT
CONTIG_292_p11_0.74%    GTT-TAATTGA-GTTGTCATATGTTAATAACGGTAT---TACCGTT---ATT
CONTIG_292_p12_0.73%    ----------G-----------------------G------TTTAATTGAGTT
CONTIG_224_p13_0.63%    ----------------------------------------------------
CONTIG_227_p14_0.62%    ----------------------------------------------------
CONTIG_231_p15_0.61%    ----------------------------------------------------
CONTIG_292_p16_0.61%    ----------GA-GTTGTCATATGTTAATAACGGTATA-TACCGTT--ATT
CONTIG_292_p17_0.6%     ---T------TGA-GTTGTCATATGTTAATAACGGTA----TACCGTT--ATT
CONTIG_292_p18_0.58%    --T-TAATTGA-GTTGTCATATGTTAATAACGGTA---TACCGTT--ATT
CONTIG_229_p19_0.54%    ----------------------------------------------------
CONTIG_260_p20_0.54%    ---------------------------------------TTTAATTGAGTT
CONTIG_259_p21_0.52%    -------------------------------TACCGTT--ATT
CONTIG_258_p22_0.5%     ---------------------------------------TTTAATTGAGTT
CONTIG_261_p23_0.46%    ---------------------------------CCGTT--ATT
CONTIG_243_p24_0.42%    -----------------------------------GTT--ATT
CONTIG_221_p25_0.41%    ----------------------------------------------------
CONTIG_237_p26_0.36%    ----------------------------------TTT---------
CONTIG_292_p27_0.36%    ---C------CGTTATTAACATATGACAACTCAATTA----TACCGTT---ATT
CONTIG_263_p28_0.32%    ---------------------------------------TTTAATTGAGTT
CONTIG_227_p29_0.32%    ----------------------------------------------------
CONTIG_264_p30_0.32%    -------------------------------TACCGTT--ATT
CONTIG_226_p31_0.32%    ----------------------------------------------------
CONTIG_264_p32_0.31%    --T------------------------------------TAATTGAGTT
CONTIG_292_p33_0.3%     -----------A-GTTGTCATATGTTAATAACGGTATA-TACCGTT--ATT
CONTIG_292_p34_0.3%     --TATAATCCT------C--ATGTCAGCCATGGAGTA-TTTGGAA--ATA
CONTIG_229_p35_0.27%    ----------------------------------------------------
```

Figure 2C

```
NCBI_gi_22123_230         ----------------------TCT-----------------------------
CONTIG_230_p1_76.03%      ----------------------TCT-----------------------------
CONTIG_264_p2_4.18%       AACATATGACAA-CTCAATTAAAC-TCT--------------------------
CONTIG_231_p3_1.21%       ----------------------TCT-----------------------------
CONTIG_292_p4_1.2%        GTCATATGTTAA-T---AACGGTAT-TCT-------------------------
CONTIG_262_p5_1%          GTCATATGTTAA-T---AACGGTA--TCT-------------------------
CONTIG_229_p6_0.93%       ----------------------TCT-----------------------------
CONTIG_262_p7_0.92%       AACATATGACAA-CTCAATTAAA---CT--------------------------
CONTIG_292_p8_0.92%       GTCATATGTTAA-T---AACGGTAT-TCT-------------------------
CONTIG_225_p9_0.91%       ------------------------------------------------------
CONTIG_292_p10_0.8%       AACATATGACAA-CTCAATTAAAC-TCT--------------------------
CONTIG_292_p11_0.74%      AACATATGACAA-CTCAATTAA--------------------------------
CONTIG_292_p12_0.73%      GTCATATGTTAA-T---AACGGTAG-TTTAATTGAGTTGTCATATGTTAAT
CONTIG_224_p13_0.63%      ------------------------------------------------------
CONTIG_227_p14_0.62%      ------------------------------------------------------
CONTIG_231_p15_0.61%      ----------------------TCT-----------------------------
CONTIG_292_p16_0.61%      AACATATGACAA-CTCAATTAAAC-TCT--------------------------
CONTIG_292_p17_0.6%       AACATATGACAA-CTCAATTAAAC-TCT--------------------------
CONTIG_292_p18_0.58%      AACATATGACAA-CTCAATTAA--------------------------------
CONTIG_229_p19_0.54%      ----------------------TCT-----------------------------
CONTIG_260_p20_0.54%      GTCATATGTTAA-T---AACGGTA------------------------------
CONTIG_259_p21_0.52%      AACATATGACAA-CTCAATTAA--------------------------------
CONTIG_258_p22_0.5%       GTCATATGTTAA-T---AACGGT-------------------------------
CONTIG_261_p23_0.46%      AACATATGACAA-CTCAATTAAAC-TCT--------------------------
CONTIG_243_p24_0.42%      AACATATGACAA-CTCAATTAAA--CCT--------------------------
CONTIG_221_p25_0.41%      ------------------------------------------------------
CONTIG_237_p26_0.36%      ----------A-------A------T-TCT------------------------
CONTIG_292_p27_0.36%      AACATATGACAA-CTCAATTAAA--CCT--------------------------
CONTIG_263_p28_0.32%      GTCATATGTTAA-T---AACGGTA--TCT-------------------------
CONTIG_227_p29_0.32%      ------------------------T-----------------------------
CONTIG_264_p30_0.32%      AACATATGACAA-CTCAATTAAAC-TCT--------------------------
CONTIG_226_p31_0.32%      ------------------------------------------------------
CONTIG_264_p32_0.31%      GTCATATGTTAA-T---AACGGTAT-TCT-------------------------
CONTIG_292_p33_0.3%       AACATATGACAA-CTCAATTAAACATCT--------------------------
CONTIG_292_p34_0.3%       CAGAAATT-CATGGTTGGTGGA-CATCT--------------------------
CONTIG_229_p35_0.27%      ------------------------CT----------------------------
```

Figure 2D

```
NCBI_gi_22123_230          ----A-CTTCTGGGAGGCCAAGGTATCTAATCAGCCATCCCATTTGTGATC    (SEQ ID NO:269)
CONTIG_230_p1_76.03%       ----A-CTTCTGGGAGGCCAAGGTATCTAATCAGCCATCCCATTTGTGATC    (SEQ ID NO:270)
CONTIG_264_p2_4.18%        ----A-CTTCTGGGAGGCCAAGGTATCTAATCAGCCATCCCATTTGTGATC    (SEQ ID NO:271)
CONTIG_231_p3_1.21%        -----A-CTTCTGGGAGGCCAAGGTATCTAATCAGCCATCCCATTTGTGATC   (SEQ ID NO:272)
CONTIG_292_p4_1.2%         ---A-CTTCTGGGAGGCCAAGGTATCTAATCAGCCATCCCATTTGTGATC     (SEQ ID NO:273)
CONTIG_262_p5_1%           ---A-CTTCTGGGAGGCCAAGGTATCTAATCAGCCATCCCATTTGTGATC     (SEQ ID NO:274)
CONTIG_229_p6_0.93%        -----A-CTTCTGGGAGGCCAAGGTATCTAATCAGCCATCCCATTTGTGATC   (SEQ ID NO:275)
CONTIG_262_p7_0.92%        -----A-CTTCTGGGAGGCCAAGGTATCTAATCAGCCATCCCATTTGTGATC   (SEQ ID NO:276)
CONTIG_292_p8_0.92%        ---A-CTTCTGGGAGGCCAAGGTATCTAATCAGCCATCCCATTTGTGATC     (SEQ ID NO:277)
CONTIG_225_p9_0.91%        --------TCTGGGAGGCCAAGGTATCTAATCAGCCATCCCATTTGTGATC    (SEQ ID NO:278)
CONTIG_292_p10_0.8%        ----A-CTTCTGGGAGGCCAAGGTATCTAATCAGCCATCCCATTTGTGATC    (SEQ ID NO:279)
CONTIG_292_p11_0.74%       -------ACCTGGGAGGCCAAGGTATCTAATCAGCCATCCCATTTGTGATC    (SEQ ID NO:280)
CONTIG_292_p12_0.73%       AACG--GTATTGGGAGGCCAAGGTATCTAATCAGCCATCCCATTTGTGATC    (SEQ ID NO:281)
CONTIG_224_p13_0.63%       ------CTTCTGGGAGGCCAAGGTATCTAATCAGCCATCCCATTTGTGATC    (SEQ ID NO:282)
CONTIG_227_p14_0.62%       ----A-CTTCTGGGAGGCCAAGGTATCTAATCAGCCATCCCATTTGTGATC    (SEQ ID NO:283)
CONTIG_231_p15_0.61%       ----A-CTTCTGGGAGGCCAAGGTATCTAATCAGCCATCCCATTTGTGATC    (SEQ ID NO:284)
CONTIG_292_p16_0.61%       ----A-CTTCTGGGAGGCCAAGGTATCTAATCAGCCATCCCATTTGTGATC    (SEQ ID NO:285)
CONTIG_292_p17_0.6%        ---A-CTTCTGGGAGGCCAAGGTATCTAATCAGCCATCCCATTTGTGATC     (SEQ ID NO:286)
CONTIG_292_p18_0.58%       -----ACCTTCTGGGAGGCCAAGGTATCTAATCAGCCATCCCATTTGTGATC   (SEQ ID NO:287)
CONTIG_229_p19_0.54%       -----A-CTTCTGGGAGGCCAAGGTATCTAATCAGCCATCCCATTTGTGATC   (SEQ ID NO:288)
CONTIG_260_p20_0.54%       -----T-CTTCTGGGAGGCCAAGGTATCTAATCAGCCATCCCATTTGTGATC   (SEQ ID NO:289)
CONTIG_259_p21_0.52%       ----A-CTTCTGGGAGGCCAAGGTATCTAATTAGCCATCCCATTTGTGATC    (SEQ ID NO:290)
CONTIG_258_p22_0.5%        --------ATTCTGGGAGGCCAAGGTATCTAATCAGCCATCCCATTTGTGATC  (SEQ ID NO:291)
CONTIG_261_p23_0.46%       ----A-CTTCTGGGAGGCCAAGGTATCTAATCAGCCATCCCATTTGTGATC    (SEQ ID NO:292)
CONTIG_243_p24_0.42%       ----A-CTTCTGGGAGGCCAAGGTATCTAATCAGCCATCCCATTTGTGATC    (SEQ ID NO:293)
CONTIG_221_p25_0.41%       ------------GGGGAGGCCAAGGTATCTAATCAGCCATCCCATTTGTGATC  (SEQ ID NO:294)
CONTIG_237_p26_0.36%       ----A-CTTCTGGGAGGCCAAGGTATCTAATCAGCCATCCCATTTGTGATC    (SEQ ID NO:295)
CONTIG_292_p27_0.36%       -----A-CTTCTGGGAGGCCAAGGTATCTAATCAGCCATCCCATTTGTGATC   (SEQ ID NO:296)
CONTIG_263_p28_0.32%       ----A-CTTCTGGGAGGCCAAGGTATCTAATCAGCCATCCCATTTGTGATC    (SEQ ID NO:297)
CONTIG_227_p29_0.32%       ---A-CTTCTGGGAGGCCAAGGTATCTAATCAGCCATCCCATTTGTGATC     (SEQ ID NO:298)
CONTIG_264_p30_0.32%       -----A-CTTCTGGGAGGCCAAGGTATCTAATCAGCCATCCCATTTGTGATC   (SEQ ID NO:299)
CONTIG_226_p31_0.32%       ----A-CTTCTGGGAGGCCAAGGTATCTAATCAGCCATCCCATTTGTGATC    (SEQ ID NO:300)
CONTIG_264_p32_0.31%       ----A-CTTCTGGGAGGCCAAGGTATCTAATCAGCCATCCCATTTGTGATC    (SEQ ID NO:301)
CONTIG_292_p33_0.3%        ----A-CTTCTGGGAGGCCAAGGTATCTAATCAGCCATCCCATTTGTGATC    (SEQ ID NO:302)
CONTIG_292_p34_0.3%        ----A-CTTCTGGGAGGCCAAGGTATCTAATCAGCCATCCCATTTGTGATC    (SEQ ID NO:303)
CONTIG_229_p35_0.27%       ---A-CTTCTGGGAGGCCAAGGTATCTAATCAGCCATCCCATTTGTGATC     (SEQ ID NO:304)
                                ******************  ********************
```

Figure 3
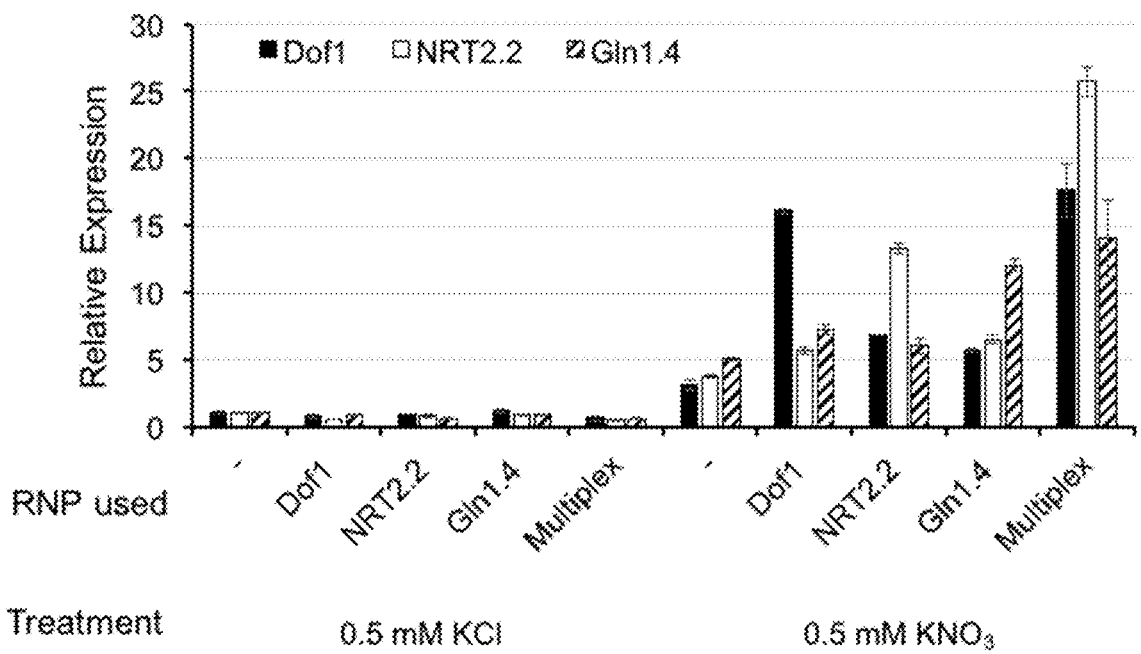
A
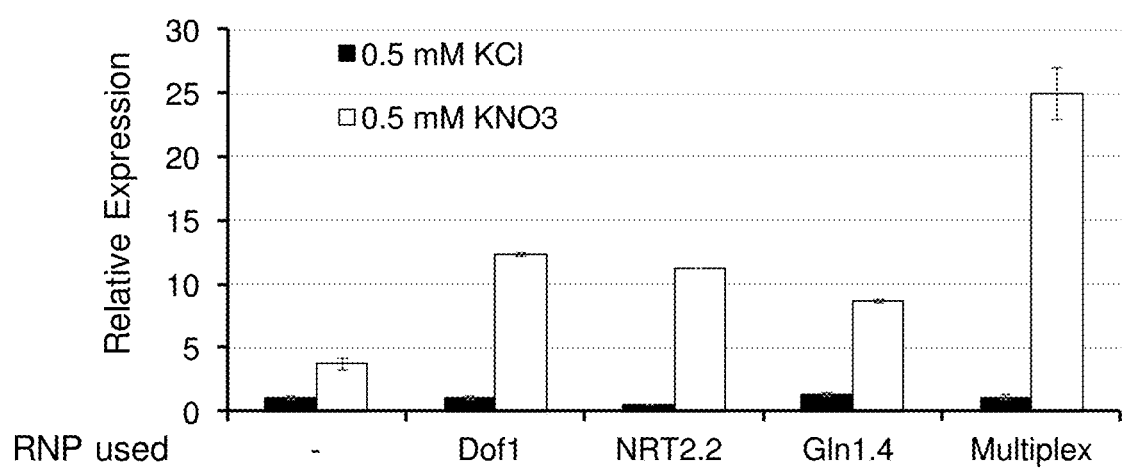
B

METHODS FOR EFFICIENT MAIZE GENOME EDITING

PRIORITY CLAIMS AND RELATED APPLICATIONS

This application claims the benefit of priority to U.S. Provisional Patent Application 62/566,180, filed on 29 Sep. 2017, which is incorporated by reference in its entirety herein.

INCORPORATION OF SEQUENCE LISTINGS

The sequence listing contained in the file named "10008P1_ST25.txt", which is 2 MB measured in operating system Windows 7 x64, and which was created on 29 Sep. 2017 and electronically filed via EFS-Web on 29 Sep. 2017, is incorporated herein by reference in its entirety. The sequence listing contained in the file named "10008US1_ST25.txt", which is 2.1 MB measured in operating system Windows 7 x64, and which was created on 26 Sep. 2018, is electronically filed herewith and incorporated by reference in its entirety.

FIELD OF THE INVENTION

Aspects of this invention relate to plant breeding methods and compositions. Disclosed herein are novel plant cells, plants and seeds derived from such plant cells and having enhanced traits, and methods of making and using such plant cells and derived plants and seeds.

BACKGROUND

Plant breeding and engineering currently relies on Mendelian genetics or recombinant techniques.

SUMMARY

Disclosed herein are methods for providing novel maize plant cells or maize plant protoplasts, plant callus, tissues or parts, whole maize plants, and maize seeds having one or more altered genetic sequences. Among other features, the methods and compositions described herein enable the stacking of preferred alleles without introducing unwanted genetic or epigenetic variation in the modified plants or plant cells. The efficiency and reliability of these targeted modification methods are significantly improved relative to traditional plant breeding, and can be used not only to augment traditional breeding techniques but also as a substitute for them.

In one aspect, the invention provides a modified *Zea* sp. cell including at least one targeted modification of a first gene and at least one targeted modification of a second gene, wherein the targeted modifications result in a change of expression in the first gene and a change of expression in the second gene, and wherein the changes of expression in the first and second genes are both associated with improvement, relative to a reference cell lacking the modifications, in an agronomically relevant trait selected from the group consisting of: abiotic stress, architecture, biotic stress, photosynthesis, and resource partitioning. In embodiments of the modified *Zea* sp. cell, the first and second genes are both selected from a group of genes associated with the same agronomically relevant trait; however, in some embodiments, either of the first and second genes or both are associated with one or more additional traits. In embodiments, the first and second genes are both selected from: (a) from the group of genes consisting of the genes identified in Table 23 to be associated with abiotic stress; or (b) from the group of genes consisting of the genes identified in Table 23 to be associated with architecture; or (c) from the group of genes consisting of the genes identified in Table 23 to be associated with biotic stress; or (d) from the group of genes consisting of the genes identified in Table 23 to be associated with photosynthesis; or (e) from the group of genes consisting of the genes identified in Table 23 to be associated with resource partitioning. In embodiments, the first and second genes are selected from: (a) a gene associated with abiotic stress, that has a DNA sequence that is at least 60% (for example, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100%) identical to a sequence selected from the group consisting of the sequences identified by SEQ ID NOs:433, 435, 437, 439, 441, 443, 445, 447, 449, 451, 453, 455, 457, 459, 461, 463, 465, 467, 469, 471, 473, 475, 477, 479, 481, 483, 485, 487, 489, 491, and 493, or that encodes a protein that has an amino acid sequence that is at least 90% (for example, at least 90%, at least 91%, at least 92%, at least 93%, at least 94%, at least 95%, at least 96%, at least 97%, at least 98%, at least 99% or 100%) identical to an amino acid sequence selected from the group consisting of the sequences identified by SEQ ID NO:434, 436, 438, 440, 442, 444, 446, 448, 450, 452, 454, 456, 458, 460, 462, 464, 466, 468, 470, 472, 474, 476, 478, 480, 482, 484, 486, 488, 490, 492, and 494; or (b) a gene associated with architecture, that has a DNA sequence that is at least 60% (for example, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100%) identical to a sequence selected from the group consisting of the sequences identified by SEQ ID NOs: 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, and 599, or that encodes a protein that has an amino acid sequence that is at least 90% (for example, at least 90%, at least 91%, at least 92%, at least 93%, at least 94%, at least 95%, at least 96%, at least 97%, at least 98%, at least 99% or 100%) identical to an amino acid sequence selected from the group consisting of the sequences identified by SEQ ID NO: 498, 500, 502, 503, 506, 508, 510, 512, 514, 516, 518, 520, 522, 524, 526, 528, 530, 532, 534, 536, 538, 540, 542, 544, 546, 548, 550, 552, 554, 556, 558, 560, 562, 566, 568, 572, 574, 576, 578, 580, 582, 584, 586, 588, 590, 592, 594, 596, 598, and 600; or (c) a gene associated with biotic stress, that has a DNA sequence that is at least 60% (for example, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100%) identical to a sequence selected from the group consisting of the sequences identified by SEQ ID NOs:601, 603, 605, 607, 609, 611, 613, 615, 617, 619, 621, 623, 625, 627, 629, 631, 633, 635, 637, 639, 643, 645, 647, 649, 651, and 653, or that encodes a protein that has an amino acid sequence that is at least 90% (for example, at least 90%, at least 91%, at least 92%, at least 93%, at least 94%, at least 95%, at least 96%, at least 97%, at least 98%, at least 99% or 100%) identical to an amino acid sequence selected from the group consisting of the sequences identified by SEQ ID NO:602, 604, 606, 608, 610, 612, 614, 616, 618, 620, 622, 624, 626, 628, 630, 632, 634, 636, 638, 640, 642, 644, 646, 648, 650, 652, 654; or (d) a gene associated with photosynthesis, that has a DNA sequence that is at least 60% (for example, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100%) identical to a sequence selected from the group consisting of the sequences identified by SEQ ID NOs:655, 657, 659, 661, 663, and 665, or that encodes a protein that has an amino acid sequence that is at least 90% (for example, at least 90%, at least 91%, at least 92%, at least 93%, at least 94%, at least 95%, at least 96%, at least 97%, at least 98%, at least 99% or 100%) identical to an amino acid sequence selected from the group consisting of the sequences identified by SEQ ID NO:656, 658, 660, 662, 664, and 666; or (e) a gene associated with resource partitioning, that has a DNA sequence that is at least 60% (for example, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100%) identical to a sequence selected from the group consisting of the sequences identified by SEQ ID NOs:667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, and 759, or that encodes a protein that has an amino acid sequence that is at least 90% (for example, at least 90%, at least 91%, at least 92%, at least 93%, at least 94%, at least 95%, at least 96%, at least 97%, at least 98%, at least 99% or 100%) identical to an amino acid sequence selected from the group consisting of the sequences identified by SEQ ID NO: 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, and 762. In embodiments, the first and second genes are both genes identified in Table 23 to be associated with resource partitioning, and wherein the changes of expression in the first and second genes are both associated with improvement, relative to a reference cell lacking the modifications, in resource partitioning, wherein the resource partitioning is nitrogen utilization or nitrogen transport. In embodiments, the first and second genes are selected from the group consisting of NRT2.2, Gln1.4, Dof1, an SPX domain-containing gene, Gln1.3, Asn synthetase, OsENOD93-1, AspAT, NAD(H)-dependent GOGAT 1, ZmDA1, and ZmDAR1. In embodiments, the first and second genes are selected from the group consisting of genes in the nitrate transporter (NRT), transcription factor Dof1, glutamine synthetase (GS), glutamate synthase (GOGAT), and alanine aminotransferase (AlaAT) enzyme families, and wherein the targeted modification results in increased expression of the first and second genes, relative to expression in a reference cell lacking the modifications; in more specific embodiments, the targeted modifications of the first and second genes include insertion of at least one nitrogen-responsive element sequence upstream of the transcription start site of the first and second genes, wherein the nitrogen-responsive element sequence is encoded by one or more polynucleotide donor molecules, and wherein at least one of the polynucleotide donor molecules lacks homology to the genome sequences adjacent to the site of insertion. In embodiments of the modified Zea sp. cell, the targeted modification is of coding sequence or of non-coding sequence; in embodiments, the targeted modification is of a combination of coding and non-coding sequence. In embodiments of the modified Zea sp. cell, the change of expression is increased expression, decreased expression, or expression of a modified coding or non-coding sequence, relative to a reference cell lacking the modifications; in embodiments, the change of expression can be a combination of these, for example, decreased expression of the first gene and increased expression of the second gene, or increased expression of a modified coding sequence, or increased expression of both the first and second gene. In embodiments, each targeted modification includes: (a) deletion of genomic sequence at a double-strand break (DSB) or between two double-strand breaks effected in coding or non-coding sequence; or (b) insertion of a predetermined sequence encoded by a polynucleotide donor molecule at a double-strand break or between two double-strand breaks effected in coding or non-coding sequence. The targeted modification of a first gene and at least one targeted modification of a second gene can be the same type of modification or can be different types of modifications. For example, in one embodiment, the modified Zea sp. cell includes the targeted modification of a first gene that includes deletion of sequence at a DSB in coding sequence and insertion of a predetermined sequence encoded by a polynucleotide donor molecule at that same locus in the coding sequence, and the targeted modification of a second gene that includes insertion of a predetermined sequence encoded by a polynucleotide donor molecule at a DSB in non-coding sequence (e.g., in the promoter region) of the second gene. In embodiments, the targeted modification of a first gene from Table 23 and the targeted modification of a second gene from Table 23 both include insertion of a predetermined sequence encoded by one or more polynucleotide donor molecules. For example, in one embodiment, the modified Zea sp. cell includes the insertion of a predetermined sequence (e.g., an expression-enhancing sequence) encoded by a polynucleotide donor molecule at a DSB in non-coding sequence (e.g., in the promoter region) of each of the first and the second gene. In embodiments, at least one of the polynucleotide donor molecules is a single stranded DNA molecule, a single stranded RNA molecule, a single stranded DNA-RNA hybrid molecule, or a duplex RNA-DNA molecule. In embodiments, at least one of the polynucleotide donor molecules lacks homology to the genome sequences adjacent to the site of insertion. In embodiments of the modified Zea sp. cell, the targeted modification is determined relative to a parent Zea sp. cell, and the modified Zea sp. cell is devoid of mitotically or meiotically generated genetic or epigenetic changes relative to the parent Zea sp. cell. Related aspects of the invention include a modified Zea sp. plant grown from the modified Zea sp. cell of claim 1, or a progeny plant or progeny seed of the modified plant, wherein cells of the modified plant, progeny plant, or progeny seed include the targeted modifications. In embodiments of the modified plant, progeny plant, or progeny seed, the first and second genes are both selected from a group of genes associated with the same agronomically relevant trait; however, in some embodiments, either of the first and second genes or both are associated with one or more additional traits. In embodiments of the modified plant, progeny plant, or progeny seed, the first and second genes include genes selected from: (a) the genes identified in Table 23 to be associated with abiotic stress; (b) the genes identified in Table 23 to be associated with architecture; (c) the genes identified in Table 23 to be associated with biotic stress; (d) the genes identified in Table 23 to be associated with photosynthesis; or (e) the genes identified in Table 23 to be associated with resource partitioning. In embodiments of the modified plant, progeny plant, or progeny seed, each of the first and second genes includes: (a) a gene that has a DNA sequence that is at least 60% (for example, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100%) identical to a sequence selected from the group consisting of the sequences identified by SEQ ID NOs:433, 435, 437, 439, 441, 443, 445, 447, 449, 451, 453, 455, 457, 459, 461, 463, 465, 467, 469, 471, 473, 475, 477, 479, 481, 483, 485, 487, 489, 491, and 493, or that encodes a protein that has an amino acid sequence that is at least 90% (for example, at least 90%, at least 91%, at least 92%, at least 93%, at least 94%, at least 95%, at least 96%, at least 97%, at least 98%, at least 99% or 100%) identical to an amino acid sequence selected from the group consisting of the sequences identified by SEQ ID NO:434, 436, 438, 440, 442, 444, 446, 448, 450, 452, 454, 456, 458, 460, 462, 464, 466, 468, 470, 472, 474, 476, 478, 480, 482, 484, 486, 488, 490, 492, and 494, and wherein the modified plant, progeny plant, or progeny seed exhibits improved tolerance of abiotic stress; (b) a gene that has a DNA sequence that is at least 60% (for example, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100%) identical to a sequence selected from the group consisting of the sequences identified by SEQ ID NOs: 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, and 599, or that encodes a protein that has an amino acid sequence that is at least 90% (for example, at least 90%, at least 91%, at least 92%, at least 93%, at least 94%, at least 95%, at least 96%, at least 97%, at least 98%, at least 99% or 100%) identical to an amino acid sequence selected from the group consisting of the sequences identified by SEQ ID NO: 498, 500, 502, 503, 506, 508, 510, 512, 514, 516, 518, 520, 522, 524, 526, 528, 530, 532, 534, 536, 538, 540, 542, 544, 546, 548, 550, 552, 554, 556, 558, 560, 562, 566, 568, 572, 574, 576, 578, 580, 582, 584, 586, 588, 590, 592, 594, 596, 598, and 600, and wherein the modified plant, progeny plant, or progeny seed exhibits modified architecture; (c) a gene that has a DNA sequence that is at least 60% (for example, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100%) identical to a sequence selected from the group consisting of the sequences identified by SEQ ID NOs:601, 603, 605, 607, 609, 611, 613, 615, 617, 619, 621, 623, 625, 627, 629, 631, 633, 635, 637, 639, 643, 645, 647, 649, 651, and 653, or that encodes a protein that has an amino acid sequence that is at least 90% (for example, at least 90%, at least 91%, at least 92%, at least 93%, at least 94%, at least 95%, at least 96%, at least 97%, at least 98%, at least 99% or 100%) identical to an amino acid sequence selected from the group consisting of the sequences identified by SEQ ID NO:602, 604, 606, 608, 610, 612, 614, 616, 618, 620, 622, 624, 626, 628, 630, 632, 634, 636, 638, 640, 642, 644, 646, 648, 650, 652, 654, and wherein the modified plant, progeny plant, or progeny seed exhibits improved tolerance of biotic stress; (d) a gene that has a DNA sequence that is at least 60% (for example, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100%) identical to a sequence selected from the group consisting of the sequences identified by SEQ ID NOs:655, 657, 659, 661, 663, and 665, or that encodes a protein that has an amino acid sequence that is at least 90% (for example, at least 90%, at least 91%, at least 92%, at least 93%, at least 94%, at least 95%, at least 96%, at least 97%, at least 98%, at least 99% or 100%) identical to an amino acid sequence selected from the group consisting of the sequences identified by SEQ ID NO:656, 658, 660, 662, 664, and 666, and wherein the modified plant, progeny plant, or progeny seed exhibits improved photosynthesis; or (e) a gene that has a DNA sequence that is at least 60% (for example, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100%) identical to a sequence selected from the group consisting of the sequences identified by SEQ ID NOs:667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, and 759, or that encodes a protein that has an amino acid sequence that is at least 90% (for example, at least 90%, at least 91%, at least 92%, at least 93%, at least 94%, at least 95%, at least 96%, at least 97%, at least 98%, at least 99% or 100%) identical to an amino acid sequence selected from the group consisting of the sequences identified by SEQ ID NO: 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, and 762, and wherein the modified plant, progeny plant, or progeny seed exhibits improved resource partitioning. In embodiments of the modified plant, progeny plant, or progeny seed, the first and second genes are both genes identified in Table 23 to be associated with resource partitioning, and wherein the changes of expression in the first and second genes are both associated with improvement, relative to a reference cell lacking the modifications, in resource partitioning, wherein the resource partitioning is nitrogen utilization or nitrogen transport. In embodiments of the modified plant, progeny plant, or progeny seed, the first and second genes are selected from the group consisting of NRT2.2, Gln1.4, Dof1, an SPX domain-containing gene, Gln1.3, Asn synthase, OsENOD93-1, AspAT, NAD(H)-dependent GOGAT 1, ZmDA1, and ZmDAR1. In embodiments of the modified plant, progeny plant, or progeny seed, the first and second genes are selected from the group consisting of genes in the nitrate transporter (NRT), transcription factor Dof1, glutamine synthetase (GS), glutamate synthase (GOGAT), and alanine aminotransferase (AlaAT) enzyme families, and wherein the targeted modification results in increased expression of the first and second genes. In embodiments of the modified plant, progeny plant, or progeny seed, the targeted modifications of the first and second genes include insertion of at least one nitrogen-responsive element sequence upstream of the transcription start site of the first and second genes, wherein the nitrogen-responsive element sequence is encoded by one or more polynucleotide donor molecules, and wherein at least one of the polynucleotide donor molecules lacks homology to the genome sequences adjacent to the site of insertion. A further aspect of the invention is related to a processed product or commodity product obtained from the modified plant, progeny plant, or progeny seed.

Another aspect of the invention provides a method of effecting in a Zea sp. genome at least one targeted modification of a first gene and at least one targeted modification of a second gene, wherein the targeted modifications result in a change of expression in the first gene and a change of expression in the second gene, wherein each targeted modification is achieved by integrating a predetermined sequence encoded by a polynucleotide donor molecule at a double-strand break (DSB) located upstream of, downstream of, or within the first or the second gene, and wherein the polynucleotide donor molecule is selected from the group consisting of a double-stranded DNA, a single-stranded DNA, a single-stranded DNA/RNA hybrid, and a double-stranded DNA/RNA hybrid. In embodiments of the method, the genome is that of a nucleus, mitochondrion, or plastid in a Zea sp. cell. In embodiments, the DSB is introduced into the Zea sp. genome by at least one of the group consisting of: (a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease; (b) a polynucleotide encoding one or more nucleases capable of effecting site-specific alteration of a target nucleotide sequence; and (c) a guide RNA (gRNA) for an RNA-guided nuclease, or a DNA encoding a gRNA for an RNA-guided nuclease. In embodiments, the DSB is introduced into the Zea sp. genome by at least one treatment selected from the group consisting of: (a) bacterially mediated (e.g., Agrobacterium sp., Rhizobium sp., Sinorhizobium sp., Mesorhizobium sp., Bradyrhizobium sp., Azobacter sp., Phyllobacterium sp.) transfection; (b) Biolistics or particle bombardment; (c) treatment with at least one chemical, enzymatic, or physical agent; and (d) application of heat or cold, ultrasonication, centrifugation, positive or negative pressure, cell wall or membrane disruption or deformation, or electroporation. In embodiments of the method, the first and second genes are both selected from a group of genes associated with the same agronomically relevant trait; however, in some embodiments, either of the first and second genes or both are associated with one or more additional traits. In embodiments of the method, the change of expression in the first gene and the change of expression in the second gene are both associated with improvement, relative to a reference Zea sp. genome lacking the targeted modifications, in an agronomically relevant trait selected from the group consisting of: abiotic stress, architecture, biotic stress, photosynthesis, and resource partitioning. In embodiments of the method, the sequence encoded by the polynucleotide donor molecule that is integrated into the double-strand break (DSB) located upstream of, downstream of, or within the first gene, and the sequence encoded by the polynucleotide donor molecule that is integrated into the double-strand break (DSB) located upstream of, downstream of, or within the second gene are (a) identical, or (b) different. A related aspect of the invention provides a Zea sp. plant cell including in its genome a heterologous DNA sequence that includes: (a) a nucleotide sequence of a polynucleotide donor molecule integrated by this method at the site of a DSB in a genome; and (b) genomic nucleotide sequence adjacent to the site of the DSB; and (c) wherein the integrated sequence is selected from the regulatory sequences listed in Table 24. A further related aspect of the invention provides a Zea sp. plant including the Zea sp. plant cell including in its genome a heterologous DNA sequence that includes: (a) a nucleotide sequence of a polynucleotide donor molecule integrated by this method at the site of a DSB in a genome; and (b) genomic nucleotide sequence adjacent to the site of the DSB; and (c) wherein the integrated sequence is selected from the regulatory sequences listed in Table 24, or a progeny plant or progeny seed of the Zea sp. plant, wherein cells of the Zea sp. plant or of the progeny plant or progeny seed include the heterologous DNA sequence.

In another aspect, the invention provides a method of changing expression of a sequence of interest in a genome, including integrating a sequence encoded by a polynucleotide, such as a double-stranded or single-stranded polynucleotides including DNA, RNA, or a combination of DNA and RNA, at the site of at least one double-strand break (DSB) in a genome, which can be the genome of a eukaryotic nucleus (e. g., the nuclear genome of a plant cell) or a genome of an organelle (e. g., a mitochondrion or a plastid in a plant cell). Effector molecules for site-specific introduction of a DSB into a genome include various endonucleases (e. g., RNA-guided nucleases such as a type II Cas nuclease, a Cas9, a type V Cas nuclease, a Cpf1, a CasY, CasX, a C2c1, or a C2c3) and guide RNAs that direct cleavage by an RNA-guided nuclease. Embodiments include those where the DSB is introduced into a genome by a ribonucleoprotein complex containing both a site-specific nuclease (e. g., Cas9, Cpf1, CasX, CasY, C2c1, C2c3) and at least one guide RNA, or by a site-specific nuclease in combination with at least one guide RNA; in some of these embodiments no plasmid or other expression vector is utilized to provide the nuclease, the guide RNA, or the polynucleotide. These effector molecules are delivered to the cell or organelle wherein the DSB is to be introduced by the use of one or more suitable composition or treatment, such as at least one chemical, enzymatic, or physical agent, or application of heat or cold, ultrasonication, centrifugation, electroporation, particle bombardment, and bacterially mediated transformation. It is generally desirable that the DSB is induced at high efficiency. One measure of efficiency is the percentage or fraction of the population of cells that have been treated with a DSB-inducing agent and in which the DSB is successfully introduced at the correct site in the genome. The efficiency of genome editing is assessed by any suitable method such as a heteroduplex cleavage assay or by sequencing, as described elsewhere in this disclosure. In various embodiments, the DSB is introduced at a comparatively high efficiency, e. g., at about 20, about 30, about 40, about 50, about 60, about 70, or about 80 percent efficiency, or at greater than 80, 85, 90, or 95 percent efficiency. In embodiments, the DSB is introduced upstream of, downstream of, or within the sequence of interest, which is coding, non-coding, or a combination of coding and non-coding sequence. In embodiments, a sequence encoded by the polynucleotide (such as a double-stranded DNA, a single-stranded DNA, a single-stranded DNA/RNA hybrid, or a double-stranded DNA/RNA hybrid), when integrated into the site of the DSB in the genome, is then functionally or operably linked to the sequence of interest, e. g., linked in a manner that modifies the transcription or the translation of the sequence of interest or that modifies the stability of a transcript including that of the sequence of interest. Embodiments include those where two or more DSBs are introduced into a genome, and wherein a sequence encoded by a polynucleotide (such as a double-stranded DNA, a single-stranded DNA, a single-stranded DNA/RNA hybrid, or a double-stranded DNA/RNA hybrid) that is integrated into each DSB is the same or different for each of the DSBs. In embodiments, at least two DSBs are introduced into a genome by one or more nucleases in such a way that genomic sequence (coding, non-coding, or a combination of coding and non-coding sequence) is deleted between the DSBs (leaving a deletion with blunt ends, overhangs or a combination of a blunt end and an overhang), and a sequence encoded by a polynucleotide (such as a double-stranded DNA, a single-stranded DNA, a single-stranded DNA/RNA hybrid, or a double-stranded DNA/RNA hybrid) molecule is integrated between the DSBs (i. e., at the location of the deleted genomic sequence). The method is particularly useful for integrating into the site of a DSB a heterologous nucleotide sequence that provides a useful function or use. For example, the method is useful for integrating or introducing into the genome a heterologous sequence that stops or knocks out expression of a sequence of interest (such as a gene encoding a protein), or a heterologous sequence that is a unique identifier nucleotide sequence, or a heterologous sequence that is (or that encodes) a sequence recognizable by a specific binding agent or that binds to a specific molecule, or a heterologous sequence that stabilizes or destabilizes a transcript containing it. Embodiments include use of the method to integrate or introduce into a genome sequence of a promoter or promoter-like element (e. g., sequence of an auxin-binding or hormone-binding or transcription-factor-binding element, or sequence of or encoding an aptamer or riboswitch), or a sequence-specific binding or cleavage site sequence (e. g., sequence of or encoding an endonuclease cleavage site, a small RNA recognition site, a recombinase site, a splice site, or a transposon recognition site). In embodiments, the method is used to delete or otherwise modify to make non-functional an endogenous functional sequence, such as a hormone- or transcription-factor-binding element, or a small RNA or recombinase or transposon recognition site. In embodiments, additional molecules are used to effect a desired expression result or a desired genomic change. For example, the method is used to integrate heterologous recombinase recognition site sequences at two DSBs in a genome, and the appropriate recombinase molecule is employed to excise genomic sequence located between the recombinase recognition sites. In another example, the method is used to integrate a polynucleotide-encoded heterologous small RNA recognition site sequence at a DSB in a sequence of interest in a genome, wherein when the small RNA is present (e. g., expressed endogenously or transiently or transgenically), the small RNA binds to and cleaves the transcript of the sequence of interest that contains the integrated small RNA recognition site. In another example, the method is used to integrate in the genome of a maize plant or plant cell a polynucleotide-encoded promoter or promoter-like element that is responsive to a specific molecule (e. g., an auxin, a hormone, a drug, an herbicide, or a polypeptide), wherein a specific level of expression of the sequence of interest is obtained by providing the corresponding specific molecule to the plant or plant cell; in a non-limiting example, an auxin-binding element is integrated into the promoter region of a protein-coding sequence in the genome of a plant or plant cell, whereby the expression of the protein is upregulated when the corresponding auxin is exogenously provided to the plant or plant cell (e. g., by adding the auxin to the medium of the plant cell or by spraying the auxin onto the plant). Another aspect of the invention is a maize cell including in its genome a heterologous DNA sequence, wherein the heterologous sequence includes (a) nucleotide sequence of a polynucleotide integrated by the method at the site of a DSB in the genome, and (b) genomic nucleotide sequence adjacent to the site of the DSB; related aspects include a plant containing such a cell including in its genome a heterologous DNA sequence, progeny seed or plants (including hybrid progeny seed or plants) of the plant, and processed or commodity products derived from the plant or from progeny seed or plants. In another aspect, the invention provides a heterologous nucleotide sequence including (a) nucleotide sequence of a polynucleotide (such as a double-stranded DNA, a single-stranded DNA, a single-stranded DNA/RNA hybrid, or a double-stranded DNA/RNA hybrid) molecule integrated by the method at the site of a DSB in a genome, and (b) genomic nucleotide sequence adjacent to the site of the DSB; related aspects include larger polynucleotides such as a plasmid, vector, or chromosome including the heterologous nucleotide sequence, as well as a polymerase primer for amplification of the heterologous nucleotide sequence.

In another aspect, the invention provides a composition including a plant cell and a polynucleotide (such as a double-stranded DNA, a single-stranded DNA, a single-stranded DNA/RNA hybrid, or a double-stranded DNA/RNA hybrid) donor molecule that is capable of being integrated at (or having its sequence integrated at) a double-strand break in genomic sequence in the plant cell. In various embodiments, the plant cell is an isolated plant cell or plant protoplast, or is in a monocot plant or dicot plant, a zygotic or somatic embryo, seed, plant part, or plant tissue. In embodiments the plant cell is capable of division or differentiation. In embodiments the plant cell is haploid, diploid, or polyploid. In embodiments, the plant cell includes a double-strand break (DSB) in its genome, at which DSB site the polynucleotide donor molecule is integrated using methods disclosed herein. In embodiments, at least one DSB is induced in the plant cell's genome by including in the composition a DSB-inducing agent, for example, various endonucleases (e. g., RNA-guided nucleases such as a type II Cas nuclease, a Cas9, a type V Cas nuclease, a Cpf1, a CasY, a CasX, a C2c1, or a C2c3) and guide RNAs that direct cleavage by an RNA-guided nuclease; the dsDNA molecule is integrated into the DSB thus induced using methods disclosed herein. Specific embodiments include compositions including a plant cell, at least one dsDNA molecule, and at least one ribonucleoprotein complex containing both a site-specific nuclease (e. g., Cas9, Cpf1, CasX, CasY, C2c1, C2c3) and at least one guide RNA; in some of these embodiments, the composition contains no plasmid or other expression vector for providing the nuclease, the guide RNA, or the dsDNA. In embodiments of the composition, the polynucleotide donor molecule is double-stranded DNA or RNA or a combination of DNA and RNA, and is blunt-ended, or contains one or more terminal overhangs, or contains chemical modifications such as phosphorothioate bonds or a detectable label. In other embodiments, the polynucleotide donor molecule is a single-stranded polynucleotide composed of DNA or RNA or a combination of DNA or RNA, and can further be chemically modified or labeled. In various embodiments of the composition, the polynucleotide donor molecule includes a nucleotide sequence that provides a useful function when integrated into the site of the DSB. For example, in various non-limiting embodiments the polynucleotide donor molecule includes: sequence that is recognizable by a specific binding agent or that binds to a specific molecule or encodes an RNA molecule or an amino acid sequence that binds to a specific molecule, or sequence that is responsive to a specific change in the physical environment or encodes an RNA molecule or an amino acid sequence that is responsive to a specific change in the physical environment, or heterologous sequence, or sequence that serves to stop transcription or translation at the site of the DSB, or sequence having secondary structure (e. g., double-stranded stems or stem-loops) or than encodes a transcript having secondary structure (e. g., double-stranded RNA that is cleavable by a Dicer-type ribonuclease). In particular embodiments, the modifications to the Zea sp. cell or plant will affect the activity or expression of one or more genes or proteins listed in Table 23, and in some embodiments two or more of those genes or proteins. In related embodiments, the activity or expression of one or more genes or proteins listed in Table 23 will be altered by the introduction or creation of one or more of the regulatory sequences listed in Table 24.

In another aspect, the invention provides a reaction mixture including: (a) a Zea sp. plant cell having at least one double-strand break (DSB) at a locus in its genome; and (b) a polynucleotide (such as a double-stranded DNA, a single-stranded DNA, a single-stranded DNA/RNA hybrid, or a double-stranded DNA/RNA hybrid) donor molecule capable of being integrated at (or having its sequence integrated at) the DSB (preferably by non-homologous end-joining (NHEJ)), wherein the polynucleotide donor molecule has a length of between about 18 to about 300 base-pairs (or nucleotides, if single-stranded), or between about 30 to about 100 base-pairs (or nucleotides, if single-stranded); wherein the polynucleotide donor molecule includes a sequence which, if integrated at the DSB, forms a heterologous insertion (wherein the sequence of the polynucleotide molecule is heterologous with respect to the genomic sequence flanking the insertion site or DSB). In embodiments of the reaction mixture, the plant cell is an isolated plant cell or plant protoplast. In various embodiments, the plant cell is an isolated plant cell or plant protoplast, or is in a monocot plant or dicot plant, a zygotic or somatic embryo, seed, plant part, or plant tissue. In embodiments the plant cell is capable of division or differentiation. In embodiments the plant cell is haploid, diploid, or polyploid. In embodiments of the reaction mixture, the polynucleotide donor molecule includes a nucleotide sequence that provides a useful function or use when integrated into the site of the DSB. For example, in various non-limiting embodiments the polynucleotide donor molecule includes: sequence that is recognizable by a specific binding agent or that binds to a specific molecule or encodes an RNA molecule or an amino acid sequence that binds to a specific molecule, or sequence that is responsive to a specific change in the physical environment or encodes an RNA molecule or an amino acid sequence that is responsive to a specific change in the physical environment, or heterologous sequence, or sequence that serves to stop transcription or translation at the site of the DSB, or sequence having secondary structure (e. g., double-stranded stems or stem-loops) or than encodes a transcript having secondary structure (e. g., double-stranded RNA that is cleavable by a Dicer-type ribonuclease).

In another aspect, the invention provides a polynucleotide for disrupting gene expression, wherein the polynucleotide is double-stranded and includes at least 18 contiguous base-pairs and encoding at least one stop codon in each possible reading frame on each strand, or is single-stranded and includes at least 11 contiguous nucleotides; and wherein the polynucleotide encodes at least one stop codon in each possible reading frame on each strand. In embodiments, the polynucleotide is a double-stranded DNA (dsDNA) or a double-stranded DNA/RNA hybrid molecule including at least 18 contiguous base-pairs and encoding at least one stop codon in each possible reading frame on either strand. In embodiments, the polynucleotide is a single-stranded DNA or a single-stranded DNA/RNA hybrid molecule including at least 11 contiguous nucleotides and encoding at least one stop codon in each possible reading frame on the strand. Such a polynucleotide is especially useful in methods disclosed herein, wherein, when a sequence encoded by the polynucleotide is integrated or inserted into a genome at the site of a DSB in a sequence of interest (such as a protein-coding gene), the sequence of the heterologously inserted polynucleotide serves to stop translation of the transcript containing the sequence of interest and the heterologously inserted polynucleotide sequence. Embodiments of the polynucleotide include those wherein the polynucleotide includes one or more chemical modifications or labels, e. g., at least one phosphorothioate modification.

In another aspect, the invention provides a method of identifying the locus of at least one double-stranded break (DSB) in genomic DNA in a cell (such as a plant cell) including the genomic DNA, wherein the method includes the steps of: (a) contacting the genomic DNA having a DSB with a polynucleotide (such as a double-stranded DNA, a single-stranded DNA, a single-stranded DNA/RNA hybrid, or a double-stranded DNA/RNA hybrid) donor molecule, wherein the polynucleotide donor molecule is capable of being integrated (or having its sequence integrated) at the DSB (preferably by non-homologous end-joining (NHEJ)) and has a length of between about 18 to about 300 base-pairs (or nucleotides, if single-stranded), or between about 30 to about 100 base-pairs (or nucleotides, if single-stranded); wherein a sequence encoded by the polynucleotide donor molecule, if integrated at the DSB, forms a heterologous insertion; and (b) using at least part of the sequence of the polynucleotide molecule as a target for PCR primers to allow amplification of DNA in the locus of the DSB. In a related aspect, the invention provides a method of identifying the locus of double-stranded breaks (DSBs) in genomic DNA in a pool of cells (such as plant cells or plant protoplasts), wherein the pool of cells includes cells having genomic DNA with a sequence encoded by a polynucleotide donor molecule inserted at the locus of the double stranded breaks; wherein the polynucleotide donor molecule is capable of being integrated (or having its sequence integrated) at the DSB and has a length of between about 18 to about 300 base-pairs (or nucleotides, if single-stranded), or between about 30 to about 100 base-pairs (or nucleotides, if single-stranded); wherein a sequence encoded by the polynucleotide donor molecule, if integrated at the DSB, forms a heterologous insertion; and wherein the sequence of the polynucleotide donor molecule is used as a target for PCR primers to allow amplification of DNA in the region of the double-stranded breaks. In embodiments, the pool of cells is a population of plant cells or plant protoplasts, wherein at least some of the cells contain multiple or different DSBs in the genome, each of which can be introduced into the genome by a different guide RNA.

In another aspect, the invention provides a method of identifying the nucleotide sequence of a locus in the genome that is associated with a phenotype, the method including the steps of: (a) providing to a population of cells having the genome: (i) multiple different guide RNAs (gRNAs) to induce multiple different double strand breaks (DSBs) in the genome, wherein each DSB is produced by an RNA-guided nuclease guided to a locus on the genome by one of the gRNAs, and (ii) polynucleotide (such as double-stranded DNA, single-stranded DNA, single-stranded DNA/RNA hybrid, and double-stranded DNA/RNA hybrid) donor molecules having a defined nucleotide sequence, wherein the polynucleotide donor molecules are capable of being integrated (or having their sequence integrated) into the DSBs by non-homologous end-joining (NHEJ); whereby when at least a sequence encoded by some of the polynucleotide donor molecules are inserted into at least some of the DSBs, a genetically heterogeneous population of cells is produced; (b) selecting from the genetically heterogeneous population of cells a subset of cells that exhibit a phenotype of interest; (c) using a pool of PCR primers that bind to at least part of the nucleotide sequence of the polynucleotide donor molecules to amplify from the subset of cells DNA from the locus of a DSB into which one of the polynucleotide donor molecules has been inserted; and (d) sequencing the amplified DNA to identify the locus associated with the phenotype of interest. In embodiments of the method, the gRNA is provided as a polynucleotide, or as a ribonucleoprotein including the gRNA and the RNA-guided nuclease. Related aspects include the cells produced by the method and pluralities, arrays, and genetically heterogeneous populations of such cells, as well as the subset of cells in which the locus associated with the phenotype has been identified, and callus, seedlings, plantlets, and plants and their seeds, grown or regenerated from such cells.

In another aspect, the invention provides a method of modifying a plant cell by creating a plurality of targeted modifications in the genome of the plant cell, wherein the method comprises contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding facilitates the generation of the plurality of targeted modifications within the genome; wherein the plurality of targeted modifications occurs without an intervening step of separately identifying an individual modification and without a step of separately selecting for the occurrence of an individual modification among the plurality of targeted modifications mediated by the targeting agents; and wherein the targeted modifications alter at least one trait of the plant cell, or at least one trait of a plant comprising the plant cell, or at least one trait of a plant grown from the plant cell, or result in a detectable phenotype in the modified plant cell; and wherein at least two of the targeted modifications are insertions of predetermined sequences encoded by one or more polynucleotide donor molecules, and wherein at least one of the polynucleotide donor molecules lacks homology to the genome sequences adjacent to the site of insertion. In a related embodiment, at least one of the polynucleotide donor molecules used in the method is a single stranded DNA molecule, a single stranded RNA molecule, a single stranded DNA-RNA hybrid molecule, or a duplex RNA-DNA molecule. In another related embodiment, wherein the modified plant cell of the method is a meristematic cell, embryonic cell, or germline cell. In yet another related embodiment, the methods described in this paragraph, when practiced repeatedly or on a pool of cells, result in an efficiency of at least 1%, e.g., at least 2%, 5%, 7%, 10%, 15%, 20%, 25%, 30%, 35% or more, wherein said efficiency is determined, e.g., by dividing the number of successfully targeted cells by the total number of cells targeted.

In another embodiment, the invention provides a method of modifying a plant cell by creating a plurality of targeted modifications in the genome of the plant cell, comprising: contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding facilitates the generation of the plurality of targeted modifications within the genome; wherein the plurality of targeted modifications occurs without an intervening step of separately identifying an individual modification and without a step of separately selecting for the occurrence of an individual modification among the plurality of targeted modifications mediated by the targeting agents; and wherein the targeted modifications improve at least one trait of the plant cell, or at least one trait of a plant comprising the plant cell, or at least one trait of a plant grown from the plant cell, or result in a detectable phenotype in the modified plant cell; and wherein at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. In a related embodiment, at least one of the polynucleotide donor molecules used in the method lacks homology to the genome sequences adjacent to the site of insertion. In another related embodiment, the modified plant cell is a meristematic cell, embryonic cell, or germline cell. In yet another related embodiment, repetition of the methods described in this paragraph result in an efficiency of at least 1%, e.g., at least 2%, 5%, 7%, 10%, 15%, 20%, 25%, 30%, 35% or more, wherein said efficiency is determined by dividing the number of successfully targeted cells by the total number of cells targeted.

In another embodiment, the invention provides a method of modifying a plant cell by creating a plurality of targeted modifications in the genome of the plant cell, comprising: contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding facilitates the generation of the plurality of targeted modifications within the genome; wherein the plurality of modifications occurs without an intervening step of separately identifying an individual modification and without a step of separately selecting for the occurrence of an individual modification among the plurality of targeted modifications mediated by the targeting agents; wherein the targeted modifications improve at least one trait of the plant cell, or at least one trait of a plant comprising the plant cell, or at least one trait of a plant or seed obtained from the plant cell, or result in a detectable phenotype in the modified plant cell; and wherein the modified plant cell is a meristematic cell, embryonic cell, or germline cell. In a related embodiment, at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. In yet another related embodiment, at least one of the polynucleotide donor molecules lacks homology to the genome sequences adjacent to the site of insertion. In yet another embodiment related to the methods of this paragraph, repetition of the method results in an efficiency of at least 1%, e.g., at least 2%, 5%, 7%, 10%, 15%, 20%, 25%, 30%, 35% or more, wherein said efficiency is determined by dividing the number of successfully targeted cells by the total number of cells targeted.

In another embodiment, the invention provides a method of modifying a Zea sp. plant cell by creating a plurality of targeted modifications in the genome of the plant cell, comprising: contacting the genome with one or more targeting agents, wherein the one or more agents comprise or encode predetermined peptide or nucleic acid sequences, wherein the predetermined peptide or nucleic acid sequences bind preferentially at or near predetermined target sites within the plant genome, and wherein the binding facilitates the generation of the plurality of targeted modifications within the genome; wherein the plurality of modifications occurs without an intervening step of separately identifying an individual modification and without a step of separately selecting for the occurrence of an individual modification among the plurality of targeted modifications mediated by the targeting agents; and wherein the targeted modifications improve at least one trait of the plant cell, or at least one trait of a plant comprising the plant cell, or at least one trait of a plant or seed obtained from the plant cell, or result in a detectable phenotype in the modified plant cell; and wherein repetition of the aforementioned steps results in an efficiency of at least 1%, e.g., at least 2%, 5%, 7%, 10%, 15%, 20%, 25%, 30%, 35% or more, wherein said efficiency is determined by dividing the number of successfully targeted cells by the total number of cells targeted. In a related embodiment, the modified plant cell is a meristematic cell, embryonic cell, or germline cell. In another related embodiment, at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. In yet another related embodiment of the methods of this paragraph, at least one of the polynucleotide donor molecules used in the method lacks homology to the genome sequences adjacent to the site of insertion.

In various embodiments of the methods described above, at least one of the targeted modifications is an insertion between 3 and 400 nucleotides in length, between 10 and 350 nucleotides in length, between 18 and 350 nucleotides in length, between 18 and 200 nucleotides in length, between 10 and 150 nucleotides in length, or between 11 and 100 nucleotides in length. In certain, embodiments, two of the targeted modifications are insertions between 10 and 350 nucleotides in length, between 18 and 350 nucleotides in length, between 18 and 200 nucleotides in length, between 10 and 150 nucleotides in length, or between 11 and 100 nucleotides in length.

In another variation of the methods described above, at least two insertions are made, and at least one of the insertions is an upregulatory sequence. In yet another variation, the targeted modification methods described above insert or create at least one transcription factor binding site. In yet another variation of the methods described above, the insertion or insertions of predetermined sequences into the plant genome are accompanied by the deletion of sequences from the plant genome.

In yet another embodiment of the targeted modification methods described above, the methods further comprise obtaining a plant from the modified plant cell and breeding the plant. In yet another embodiment, the methods described above comprise a step of introducing additional genetic or epigenetic changes into the modified plant cell or into a plant grown from the modified plant cell.

In an embodiment of the targeted modification methods described above, at least two targeted insertions are made and the targeted insertions independently up- or down-regulate the expression of two or more distinct genes. For example, a targeted insertion may increase expression at least 10%, 15%, 20%, 25%, 30%, 35%, 40%, 50%, 60%, 70%, 80%, 90%, 95%, 100% or greater, e.g., at least a 2-fold, 5-fold, 10-fold, 20-fold, 30-fold, 40-fold, 50-fold change, 100-fold or even 1000-fold change or more. In some embodiments, expression is increased between 10-100%; between 2-fold and 5-fold; between 2 and 10-fold; between 10-fold and 50-fold; between 10-fold and a 100-fold; between 100-fold and 1000-fold; between 1000-fold and 5,000-fold; between 5,000-fold and 10,000 fold. In some embodiments, a targeted insertion may decrease expression by at least 1%, 5%, 10%, 15%, 20%, 25%, 30%, 35%, 40%, 50%, 60%, 70%, 80%, 90%, 95%, 99% or more.

In yet another embodiment of the targeted insertion methods described above, the donor polynucleotide is tethered to a crRNA by a covalent bond, a non-covalent bond, or a combination of covalent and non-covalent bonds. In a related embodiment, the invention provides a composition for targeting a genome comprising a donor polynucleotide tethered to a cRNA by a covalent bond, a non-covalent bond, or a combination of covalent and non-covalent bonds.

In another embodiment of the targeted modification methods described above, the loss of epigenetic marks after modifying occurs in less than 0.1%, 0.08%, 0.05%, 0.02%, or 0.01% of the genome. In yet another embodiment of the targeted modification methods described above, the genome of the modified plant cell is more than 99%, e.g., more than 99.5% or more than 99.9% identical to the genome of the parent cell.

In yet another embodiment of the targeted modification methods described above, at least one of the targeted modifications is an insertion and at least one insertion is in a region of the genome that is recalcitrant to meiotic or mitotic recombination.

In certain embodiments of the plant cell genome targeting methods described above, the plant cell is a member of a pool of cells being targeted. In related embodiments, the modified cells within the pool are characterized by sequencing after targeting.

The invention also provides modified Zea sp. plant cells comprising at least two separately targeted insertions in its genome, wherein the insertions are determined relative to a parent plant cell, and wherein the modified plant cell is devoid of mitotically or meiotically generated genetic or epigenetic changes relative to the parent plant cell. In certain embodiments, these plant cells are obtained using the multiplex targeted insertion methods described above. In certain embodiments, the modified plant cells comprise at least two separately targeted insertions, wherein the genome of the modified plant cell is at least 95%, at least 96%, at least 97%, at least 98%, at least 99%, at least 99.5%, at least 99.9%, or at least 99.99% identical to the parent cell, taking all genetic or epigenetic changes into account.

The invention also provides modified plant cells resulting from any of the claimed methods described, as well as recombinant plants grown from those modified plant cells.

In some embodiments, the invention provides a method of manufacturing a processed plant product, comprising: (a) modifying a plant cell according to any of the targeted methods described above; (b) growing a modified plant from said plant cell, and (c) processing the modified plant into a processed product, thereby manufacturing a processed plant product. In related embodiments, the processed product may be meal, oil, juice, sugar, starch, fiber, an extract, wood or wood pulp, flour, cloth or some other commodity plant product. The invention also provides a method of manufacturing a plant product, comprising (a) modifying a plant cell according to any of the targeted methods described above, (b) growing an modified plant from said plant cell, and (c) harvesting a product of the modified plant, thereby manufacturing a plant product. In related embodiments, the plant product is a product may be leaves, fruit, vegetables, nuts, seeds, oil, wood, flowers, cones, branches, hay, fodder, silage, stover, straw, pollen, or some other harvested commodity product. In further related embodiments, the processed products and harvested products are packaged.

BRIEF DESCRIPTION OF THE DRAWINGS

FIGS. 1A-1C depict the Clustal-W (1.83) multiple-sequence alignment of the next-generation sequencing reads of the maize (Zea mays) alcohol dehydrogenase ADH1 that were amplified and sequenced as described in detail in Example 4. Sequencing reads are identified by a number beginning with the letter P and are listed from highest to lowest percentage of total NGS reads. P1 identifies the non-edited sequence, i. e., identical to the reference sequence identified at the beginning of the list by an "NCBI_gi" number (NCBI accession number). Asterisks in the last line of the alignment indicate conserved nucleotides.

FIGS. 2A-2D depict the Clustal-W (1.83) multiple-sequence alignment of the next-generation sequencing reads of the maize (Zea mays) alcohol dehydrogenase ADH1 that were amplified and sequenced as described in detail in Example 8. Sequencing reads are identified by a number beginning with the letter P and are listed from highest to lowest percentage of total NGS reads. P1 identifies the non-edited sequence, i.e., identical to the reference sequence identified at the beginning of the list by an "NCBI_gi" number (NCBI accession number). Asterisks in the last line of the alignment indicate conserved nucleotides.

FIG. 3 depicts results of experiments described in detail in Example 20. Panel A illustrates mean relative gene expression of Dof1 (solid black bars), NRT2.2 (solid white bars), and Gln1.4 (diagonally hatched bars) genes, normalized to tubulin expression. Null controls are indicated by the "-" symbol. Panel B illustrates mean relative gene expression of the unmodified, endogenous AMT3, normalized to tubulin expression, in the presence of KCl (solid black bars) or $KNO_3$ (solid white bars), in cells where the Dof1, NRT2.2, and Gln1.4 genes were individually modified, or where all three genes were modified ("Multiplex"). Null controls are indicated by the "-" symbol.

DETAILED DESCRIPTION OF THE INVENTION

Definitions

Figure 4:
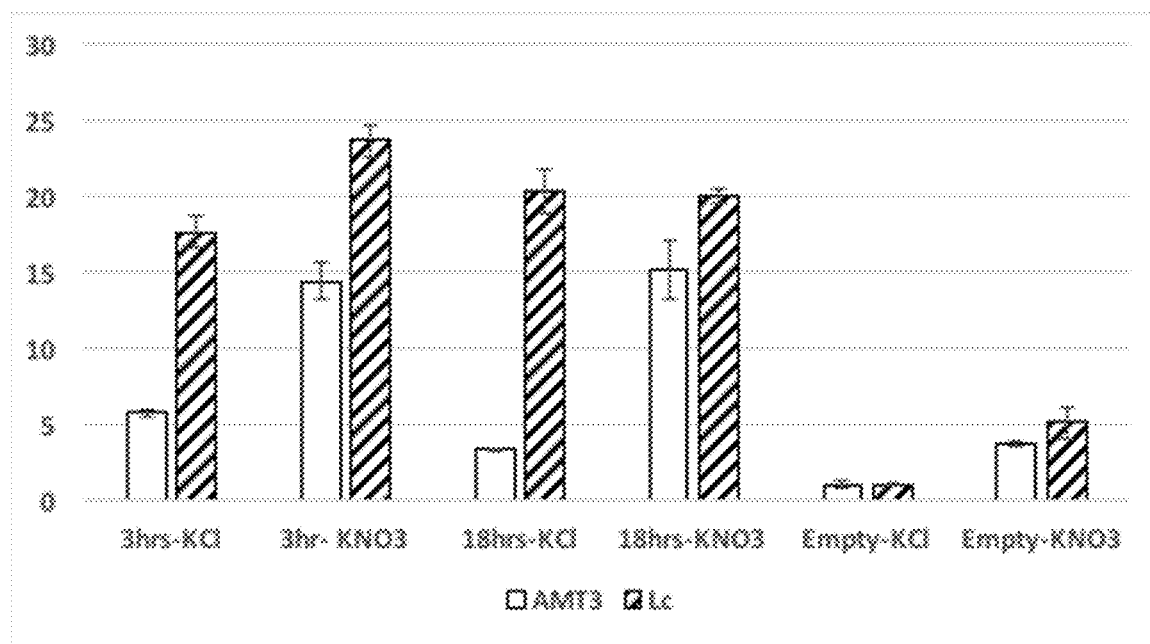
FIG. 4 depicts results of experiments described in detail in Example 23, and illustrates mean relative gene expression of AMT3 (solid white bars) and Lc (diagonally hatched bars) genes, normalized to tubulin expression, in the presence of KCl or $KNO_3$. "3 hrs" and "18 hrs" refer to cells that were subjected to a second (ZmLc-Pro3/OCS homologue) transfection or editing reaction 3 or 18 hours, respectively, after a first (AMT3-Pro1/AtNRE) transfection. Null controls are indicated by "Empty".

Unless otherwise stated, nucleic acid sequences in the text of this specification are given, when read from left to right, in the 5' to 3' direction. Nucleic acid sequences may be provided as DNA or as RNA, as specified; disclosure of one necessarily defines the other, as well as necessarily defines the exact complements, as is known to one of ordinary skill in the art. Where a term is provided in the singular, the inventors also contemplate aspects of the invention described by the plural of that term.

By "polynucleotide" is meant a nucleic acid molecule containing multiple nucleotides and refers to "oligonucleotides" (defined here as a polynucleotide molecule of between 2-25 nucleotides in length) and polynucleotides of 26 or more nucleotides. Polynucleotides are generally described as single- or double-stranded. Where a polynucleotide contains double-stranded regions formed by intra- or intermolecular hybridization, the length of each double-stranded region is conveniently described in terms of the number of base pairs. Aspects of this invention include the use of polynucleotides or compositions containing polynucleotides; embodiments include one or more oligonucleotides or polynucleotides or a mixture of both, including single- or double-stranded RNA or single- or double-stranded DNA or single- or double-stranded DNA/RNA hybrids or chemically modified analogues or a mixture thereof. In various embodiments, a polynucleotide (such as a single-stranded DNA/RNA hybrid or a double-stranded DNA/RNA hybrid) includes a combination of ribonucleotides and deoxyribonucleotides (e. g., synthetic polynucleotides consisting mainly of ribonucleotides but with one or more terminal deoxyribonucleotides or synthetic polynucleotides consisting mainly of deoxyribonucleotides but with one or more terminal dideoxyribonucleotides), or includes non-canonical nucleotides such as inosine, thiouridine, or pseudouridine. In embodiments, the polynucleotide includes chemically modified nucleotides (see, e. g., Verma and Eckstein (1998) Annu. Rev. Biochem., 67:99-134); for example, the naturally occurring phosphodiester backbone of an oligonucleotide or polynucleotide can be partially or completely modified with phosphorothioate, phosphorodithioate, or methylphosphonate internucleotide linkage modifications; modified nucleoside bases or modified sugars can be used in oligonucleotide or polynucleotide synthesis; and oligonucleotides or polynucleotides can be labeled with a fluorescent moiety (e. g., fluorescein or rhodamine or a fluorescence resonance energy transfer or FRET pair of chromophore labels) or other label (e. g., biotin or an isotope). Modified nucleic acids, particularly modified RNAs, are disclosed in U.S. Pat. No. 9,464,124, incorporated by reference in its entirety herein. For some polynucleotides (especially relatively short polynucleotides, e. g., oligonucleotides of 2-25 nucleotides or base-pairs, or polynucleotides of about 25 to about 300 nucleotides or base-pairs), use of modified nucleic acids, such as locked nucleic acids ("LNAs"), is useful to modify physical characteristics such as increased melting temperature ($T_m$) of a polynucleotide duplex incorporating DNA or RNA molecules that contain one or more LNAs; see, e. g., You et al. (2006) Nucleic Acids Res., 34:1-11 (e60), doi:10.1093/nar/gkl175.

In the context of the genome targeting methods described herein, the phrase "contacting a genome" with an agent means that an agent responsible for effecting the targeted genome modification (e.g., a break, a deletion, a rearrangement, or an insertion) is delivered to the interior of the cell so the directed mutagenic action can take place.

Tools and Methods for Multiplex Editing

CRISPR technology for editing the genes of eukaryotes is disclosed in U.S. Patent Application Publications 2016/0138008A1 and US2015/0344912A1, and in U.S. Pat. Nos.

8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cpf1 endonuclease and corresponding guide RNAs and PAM sites are disclosed in U.S. Patent Application Publication 2016/0208243 A1. Other CRISPR nucleases useful for editing genomes include C2c1 and C2c3 (see Shmakov et al. (2015) *Mol. Cell,* 60:385-397) and CasX and CasY (see Burstein et al. (2016) *Nature,* doi:10.1038/nature21059). Plant RNA promoters for expressing CRISPR guide RNA and plant codon-optimized CRISPR Cas9 endonuclease are disclosed in International Patent Application PCT/US2015/018104 (published as WO 2015/131101 and claiming priority to U.S. Provisional Patent Application 61/945,700). Methods of using CRISPR technology for genome editing in plants are disclosed in in U.S. Patent Application Publications US 2015/0082478A1 and US 2015/0059010A1 and in International Patent Application PCT/US2015/038767 A1 (published as WO 2016/007347 and claiming priority to U.S. Provisional Patent Application 62/023,246).

CRISPR (Clustered Regularly Interspaced Short Palindromic Repeats)/Cas (CRISPR-associated) systems, or CRISPR systems, are adaptive defense systems originally discovered in bacteria and archaea. CRISPR systems use RNA-guided nucleases termed CRISPR-associated or "Cas" endonucleases (e. g., Cas9 or Cpf1) to cleave foreign DNA. In a typical CRISPR/Cas system, a Cas endonuclease is directed to a target nucleotide sequence (e. g., a site in the genome that is to be sequence-edited) by sequence-specific, non-coding "guide RNAs" that target single- or double-stranded DNA sequences. In microbial hosts, CRISPR loci encode both Cas endonucleases and "CRISPR arrays" of the non-coding RNA elements that determine the specificity of the CRISPR-mediated nucleic acid cleavage.

Three classes (I-III) of CRISPR systems have been identified across a wide range of bacterial hosts. The well characterized class II CRISPR systems use a single Cas endonuclease (rather than multiple Cas proteins). One class II CRISPR system includes a type II Cas endonuclease such as Cas9, a CRISPR RNA ("crRNA"), and a trans-activating crRNA ("tracrRNA"). The crRNA contains a "guide RNA", typically a 20-nucleotide RNA sequence that corresponds to (i. e., is identical or nearly identical to, or alternatively is complementary or nearly complementary to) a 20-nucleotide target DNA sequence. The crRNA also contains a region that binds to the tracrRNA to form a partially double-stranded structure which is cleaved by RNase III, resulting in a crRNA/tracrRNA hybrid. The crRNA/tracrRNA hybrid then directs the Cas9 endonuclease to recognize and cleave the target DNA sequence.

The target DNA sequence must generally be adjacent to a "protospacer adjacent motif" ("PAM") that is specific for a given Cas endonuclease; however, PAM sequences are short and relatively non-specific, appearing throughout a given genome. CRISPR endonucleases identified from various prokaryotic species have unique PAM sequence requirements; examples of PAM sequences include 5'-NGG (*Streptococcus pyogenes*), 5'-NNAGAA (*Streptococcus thermophilus* CRISPR1), 5'-NGGNG (*Streptococcus thermophilus* CRISPR3), 5'-NNGRRT or 5'-NNGRR (*Staphylococcus aureus* Cas9, SaCas9), and 5'-NNNGATT (*Neisseria meningitidis*). Some endonucleases, e. g., Cas9 endonucleases, are associated with G-rich PAM sites, e. g., 5'-NGG, and perform blunt-end cleaving of the target DNA at a location 3 nucleotides upstream from (5' from) the PAM site.

Another class II CRISPR system includes the type V endonuclease Cpf1 (also known as Cas12a), which is a smaller endonuclease than is Cas9; examples include AsCpf1 (from *Acidaminococcus* sp.) and LbCpf1 (from *Lachnospiraceae* sp.). Cpf1-associated CRISPR arrays are processed into mature crRNAs without the requirement of a tracrRNA; in other words, a Cpf1 system requires only the Cpf1 nuclease and a crRNA to cleave the target DNA sequence. Cpf1 endonucleases, are associated with T-rich PAM sites, e. g., 5'-TTN. Cpf1 can also recognize a 5'-CTA PAM motif. Cpf1 cleaves the target DNA by introducing an offset or staggered double-strand break with a 4- or 5-nucleotide 5' overhang, for example, cleaving a target DNA with a 5-nucleotide offset or staggered cut located 18 nucleotides downstream from (3' from) from the PAM site on the coding strand and 23 nucleotides downstream from the PAM site on the complimentary strand; the 5-nucleotide overhang that results from such offset cleavage allows more precise genome editing by DNA insertion by homologous recombination than by insertion at blunt-end cleaved DNA. See, e. g., Zetsche et al. (2015) *Cell,* 163:759-771. Other CRISPR nucleases useful in methods and compositions of the invention include C2c1 and C2c3 (see Shmakov et al. (2015) *Mol. Cell,* 60:385-397). Like other CRISPR nucleases, C2c1 from *Alicyclobacillus acidoterrestris* (AacC2c1; amino acid sequence with accession ID T0D7A2, deposited on-line at www[dot]ncbi[dot]nlm[dot]nih[dot]gov/protein/1076761101) requires a guide RNA and PAM recognition site; C2c1 cleavage results in a staggered seven-nucleotide DSB in the target DNA (see Yang et al. (2016) *Cell,* 167:1814-1828.e12) and is reported to have high mismatch sensitivity, thus reducing off-target effects (see Liu et al. (2016) *Mol. Cell*, available on line at dx[dot]doi[dot]org/10[dot]1016/j[dot]molcel[dot]2016[dot]11.040). Yet other CRISPR nucleases include nucleases identified from the genomes of uncultivated microbes, such as CasX and CasY (e. g., a CRISPR-associated protein CasY from an uncultured Parcubacteria group bacterium, amino acid sequence with accession ID APG80656, deposited on-line at www[dot]ncbi[dot]nlm[dot]nih[dot]gov/protein/APG80656.1]); see Burstein et al. (2016) *Nature*, doi:10.1038/nature21059.

For the purposes of gene editing, CRISPR arrays can be designed to contain one or multiple guide RNA sequences corresponding to a desired target DNA sequence; see, for example, Cong et al. (2013) *Science*, 339:819-823; Ran et al. (2013) *Nature Protocols*, 8:2281-2308. At least 16 or 17 nucleotides of gRNA sequence are required by Cas9 for DNA cleavage to occur; for Cpf1 at least 16 nucleotides of gRNA sequence are needed to achieve detectable DNA cleavage and at least 18 nucleotides of gRNA sequence were reported necessary for efficient DNA cleavage in vitro; see Zetsche et al. (2015) *Cell*, 163:759-771. In practice, guide RNA sequences are generally designed to have a length of between 17-24 nucleotides (frequently 19, 20, or 21 nucleotides) and exact complementarity (i. e., perfect base-pairing) to the targeted gene or nucleic acid sequence; guide RNAs having less than 100% complementarity to the target sequence can be used (e. g., a gRNA with a length of 20 nucleotides and between 1-4 mismatches to the target sequence) but can increase the potential for off-target effects. The design of effective guide RNAs for use in plant genome editing is disclosed in U.S. Patent Application Publication 2015/0082478 A1, the entire specification of which is incorporated herein by reference. More recently, efficient gene editing has been achieved using a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing); see, for example, Cong et al. (2013) *Science,* 339:819-823; Xing et al. (2014) *BMC Plant Biol.,* 14:327-340. Chemically modified sgRNAs have been demonstrated to be effective in genome editing; see, for example, Hendel et al. (2015) *Nature Biotechnol.,* 985-991.

CRISPR-type genome editing has value in various aspects of agriculture research and development. CRISPR elements, i.e., CRISPR endonucleases and CRISPR single-guide RNAs, are useful in effecting genome editing without remnants of the CRISPR elements or selective genetic markers occurring in progeny. Alternatively, genome-inserted CRISPR elements are useful in plant lines adapted for multiplex genetic screening and breeding. For instance, a plant species can be created to express one or more of a CRISPR endonuclease such as a Cas9- or a Cpf1-type endonuclease or combinations with unique PAM recognition sites. Cpf1 endonuclease and corresponding guide RNAs and PAM sites are disclosed in U.S. Patent Application Publication 2016/0208243 A1, which is incorporated herein by reference for its disclosure of DNA encoding Cpf1 endonucleases and guide RNAs and PAM sites. Introduction of one or more of a wide variety of CRISPR guide RNAs that interact with CRISPR endonucleases integrated into a plant genome or otherwise provided to a plant is useful for genetic editing for providing desired phenotypes or traits, for trait screening, or for trait introgression. Multiple endonucleases can be provided in expression cassettes with the appropriate promoters to allow multiple genome editing in a spatially or temporally separated fashion in either in chromosome DNA or episome DNA.

Whereas wild-type Cas9 generates double-strand breaks (DSBs) at specific DNA sequences targeted by a gRNA, a number of CRISPR endonucleases having modified functionalities are available, for example: (1) a "nickase" version of Cas9 generates only a single-strand break; (2) a catalytically inactive Cas9 ("dCas9") does not cut the target DNA but interferes with transcription; (3) dCas9 on its own or fused to a repressor peptide can repress gene expression; (4) dCas9 fused to an activator peptide can activate or increase gene expression; (5) dCas9 fused to FokI nuclease ("dCas9-FokI") can be used to generate DSBs at target sequences homologous to two gRNAs; and (6) dCas9 fused to histone-modifying enzymes (e. g., histone acetyltransferases, histone methyltransferases, histone deacetylases, and histone demethylases) can be used to alter the epigenome in a site-specific manner, for example, by changing the methylation or acetylation status at a particular locus. See, e. g., the numerous CRISPR/Cas9 plasmids disclosed in and publicly available from the Addgene repository (Addgene, 75 Sidney St., Suite 550A, Cambridge, Mass. 02139; addgene[dot]org/crispr/). A "double nickase" Cas9 that introduces two separate double-strand breaks, each directed by a separate guide RNA, is described as achieving more accurate genome editing by Ran et al. (2013) *Cell,* 154:1380-1389.

In some embodiments, the methods of targeted modification described herein provide a means for avoiding unwanted epigenetic losses that can arise from tissue culturing modified plant cells (see, e.g., Stroud et al. *eLife* 2013; 2:e00354). Using the methods described herein in the absence of tissue culture, a loss of epigenetic marking may occur in less than 0.01% of the genome. This contrasts with results obtained with rice plants where tissue culture methods may result in losses of DNA methylation that occur, on average, as determined by bisulfite sequencing, at 1344 places that are on average 334 base pairs long, which means a loss of DNA methylation at an average of 0.1% of the genome (Stroud, 2013). In other words, the loss in marks using the targeted modification techniques described herein without tissue culture is 10 times lower than the loss observed when tissue culture techniques are relied on. In certain embodiments of the novel modified plant cells described herein, the modified plant cell or plant does not have significant losses of methylation compared to a non-modified parent plant cell or plant; in other words, the methylation pattern of the genome of the modified plant cell or plant is not greatly different from the methylation pattern of the genome of the parent plant cell or plant; in embodiments, the difference between the methylation pattern of the genome of the modified plant cell or plant and that of the parent plant cell or plant is less than 0.1%, 0.05%, 0.02%, or 0.01% of the genome, or less than 0.005% of the genome, or less than 0.001% of the genome (see, e. g., Stroud et al. (2013) *eLife* 2:e00354; DOI: 10.7554/eLife.00354).

CRISPR technology for editing the genes of eukaryotes is disclosed in U.S. Patent Application Publications 2016/0138008A1 and US2015/0344912A1, and in U.S. Pat. Nos. 8,697,359, 8,771,945, 8,945,839, 8,999,641, 8,993,233, 8,895,308, 8,865,406, 8,889,418, 8,871,445, 8,889,356, 8,932,814, 8,795,965, and 8,906,616. Cpf1 endonuclease and corresponding guide RNAs and PAM sites are disclosed in U.S. Patent Application Publication 2016/0208243 A1. Plant RNA promoters for expressing CRISPR guide RNA and plant codon-optimized CRISPR Cas9 endonuclease are disclosed in International Patent Application PCT/US2015/018104 (published as WO 2015/131101 and claiming priority to U.S. Provisional Patent Application 61/945,700). Methods of using CRISPR technology for genome editing in plants are disclosed in in U.S. Patent Application Publications US 2015/0082478A1 and US 2015/0059010A1 and in International Patent Application PCT/US2015/038767 A1 (published as WO 2016/007347 and claiming priority to U.S. Provisional Patent Application 62/023,246). All of the patent publications referenced in this paragraph are incorporated herein by reference in their entirety.

In some embodiments, one or more vectors driving expression of one or more polynucleotides encoding elements of a genome-editing system (e. g., encoding a guide RNA or a nuclease) are introduced into a plant cell or a plant protoplast, whereby these elements, when expressed, result in alteration of a target nucleotide sequence. In embodiments, a vector comprises a regulatory element such as a promoter operably linked to one or more polynucleotides encoding elements of a genome-editing system. In such embodiments, expression of these polynucleotides can be controlled by selection of the appropriate promoter, particularly promoters functional in a plant cell; useful promoters include constitutive, conditional, inducible, and temporally or spatially specific promoters (e. g., a tissue specific promoter, a developmentally regulated promoter, or a cell cycle regulated promoter). In embodiments, the promoter is operably linked to nucleotide sequences encoding multiple guide RNAs, wherein the sequences encoding guide RNAs are separated by a cleavage site such as a nucleotide sequence encoding a microRNA recognition/cleavage site or a self-cleaving ribozyme (see, e. g., Ferré-D'Amaré and Scott (2014) *Cold Spring Harbor Perspectives Biol.,* 2:a003574). In embodiments, the promoter is a pol II promoter operably linked to a nucleotide sequence encoding one or more guide RNAs. In embodiments, the promoter operably linked to one or more polynucleotides encoding elements of a genome-editing system is a constitutive promoter that drives DNA expression in plant cells; in embodiments, the promoter drives DNA expression in the nucleus or in an organelle such as a chloroplast or mitochondrion. Examples of constitutive promoters include a CaMV 35S promoter as disclosed in U.S. Pat. Nos. 5,858,742 and 5,322,938, a rice actin promoter as disclosed in U.S. Pat. No. 5,641,876, a maize chloroplast aldolase promoter as disclosed in U.S. Pat. No. 7,151,204, and a opaline synthase (NOS) and octapine synthase (OCS) promoter from *Agrobacterium tumefaciens*. In embodiments, the promoter operably linked to one or more polynucleotides encoding elements of a genome-editing system is a promoter from figwort mosaic virus (FMV), a RUBISCO promoter, or a pyruvate phosphate dikinase (PDK) promoter, which is active in the chloroplasts of mesophyll cells. Other contemplated promoters include cell-specific or tissue-specific or developmentally regulated promoters, for example, a promoter that limits the expression of the nucleic acid targeting system to germline or reproductive cells (e. g., promoters of genes encoding DNA ligases, recombinases, replicases, or other genes specifically expressed in germline or reproductive cells); in such embodiments, the nuclease-mediated genetic modification (e. g., chromosomal or episomal double-stranded DNA cleavage) is limited only those cells from which DNA is inherited in subsequent generations, which is advantageous where it is desirable that expression of the genome-editing system be limited in order to avoid genotoxicity or other unwanted effects. All of the patent publications referenced in this paragraph are incorporated herein by reference in their entirety.

In some embodiments, elements of a genome-editing system (e.g., an RNA-guided nuclease and a guide RNA) are operably linked to separate regulatory elements on separate vectors. In other embodiments, two or more elements of a genome-editing system expressed from the same or different regulatory elements or promoters are combined in a single vector, optionally with one or more additional vectors providing any additional necessary elements of a genome-editing system not included in the first vector. For example, multiple guide RNAs can be expressed from one vector, with the appropriate RNA-guided nuclease expressed from a second vector. In another example, one or more vectors for the expression of one or more guide RNAs (e. g., crRNAs or sgRNAs) are delivered to a cell (e. g., a plant cell or a plant protoplast) that expresses the appropriate RNA-guided nuclease, or to a cell that otherwise contains the nuclease, such as by way of prior administration thereto of a vector for in vivo expression of the nuclease.

Genome-editing system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In embodiments, the endonuclease and the nucleic acid-targeting guide RNA may be operably linked to and expressed from the same promoter. In embodiments, a single promoter drives expression of a transcript encoding an endonuclease and the guide RNA, embedded within one or more intron sequences (e. g., each in a different intron, two or more in at least one intron, or all in a single intron), which can be plant-derived; such use of introns is especially contemplated when the expression vector is being transformed or transfected into a monocot plant cell or a monocot plant protoplast.

Expression vectors provided herein may contain a DNA segment near the 3' end of an expression cassette that acts as a signal to terminate transcription and directs polyadenylation of the resultant mRNA. Such a 3' element is commonly referred to as a "3'-untranslated region" or "3'-UTR" or a "polyadenylation signal". Useful 3' elements include: *Agrobacterium tumefaciens* nos 3', tml 3', tmr 3', tms 3', ocs 3', and tr7 3' elements disclosed in U.S. Pat. No. 6,090,627, incorporated herein by reference, and 3' elements from plant genes such as the heat shock protein 17, ubiquitin, and fructose-1,6-biphosphatase genes from wheat (*Triticum aestivum*), and the glutelin, lactate dehydrogenase, and beta-tubulin genes from rice (*Oryza sativa*), disclosed in U.S. Patent Application Publication 2002/0192813 A1, incorporated herein by reference.

In certain embodiments, a vector or an expression cassette includes additional components, e. g., a polynucleotide encoding a drug resistance or herbicide gene or a polynucleotide encoding a detectable marker such as green fluorescent protein (GFP) or beta-glucuronidase (gus) to allow convenient screening or selection of cells expressing the vector. In embodiments, the vector or expression cassette includes additional elements for improving delivery to a plant cell or plant protoplast or for directing or modifying expression of one or more genome-editing system elements, for example, fusing a sequence encoding a cell-penetrating peptide, localization signal, transit, or targeting peptide to the RNA-guided nuclease, or adding a nucleotide sequence to stabilize a guide RNA; such fusion proteins (and the polypeptides encoding such fusion proteins) or combination polypeptides, as well as expression cassettes and vectors for their expression in a cell, are specifically claimed. In embodiments, an RNA-guided nuclease (e. g., Cas9, Cpf1, CasY, CasX, C2c1, or C2c3) is fused to a localization signal, transit, or targeting peptide, e. g., a nuclear localization signal (NLS), a chloroplast transit peptide (CTP), or a mitochondrial targeting peptide (MTP); in a vector or an expression cassette, the nucleotide sequence encoding any of these can be located either 5' and/or 3' to the DNA encoding the nuclease. For example, a plant-codon-optimized Cas9 (pco-Cas9) from *Streptococcus pyogenes* and *S. thermophilus* containing nuclear localization signals and codon-optimized for expression in maize is disclosed in PCT/US2015/018104 (published as WO/2015/131101 and claiming priority to U.S. Provisional Patent Application 61/945,700), incorporated herein by reference. In another example, a chloroplast-targeting RNA is appended to the 5' end of an mRNA encoding an endonuclease to drive the accumulation of the mRNA in chloroplasts; see Gomez, et al. (2010) *Plant Signal Behav.*, 5: 1517-1519. In an embodiment, a Cas9 from *Streptococcus pyogenes* is fused to a nuclear localization signal (NLS), such as the NLS from SV40. In an embodiment, a Cas9 from *Streptococcus pyogenes* is fused to a cell-penetrating peptide (CPP), such as octa-arginine or nona-arginine or a homoarginine 12-mer oligopeptide, or a CPP disclosed in the database of cell-penetrating peptides CPPsite 2.0, publicly available at crdd[dot]osdd[dot]net/raghava/cppsite/. In an example, a Cas9 from *Streptococcus pyogenes* (which normally carries a net positive charge) is modified at the N-terminus with a negatively charged glutamate peptide "tag" and at the C-terminus with a nuclear localization signal (NLS); when mixed with cationic arginine gold nanoparticles (ArgNPs), self-assembled nanoassemblies were formed which were shown to provide good editing efficiency in human cells; see Mout et al. (2017) *ACS Nano*, doi:10.1021/acsnano.6b07600. In an embodiment, a Cas9 from *Streptococcus pyogenes* is fused to a chloroplast transit peptide (CTP) sequence. In embodiments, a CTP sequence is obtained from any nuclear gene that encodes a protein that targets a chloroplast, and the isolated or synthesized CTP DNA is appended to the 5' end of the DNA that encodes a nuclease targeted for use in a chloroplast. Chloroplast transit peptides and their use are described in U.S. Pat. Nos. 5,188,642, 5,728,925, and 8,420,888, all of which are incorporated herein by reference in their entirety. Specifically, the CTP nucleotide sequences provided with the sequence identifier (SEQ ID) numbers 12-15 and 17-22 of U.S. Pat. No. 8,420,888 are incorporated herein by reference. In an embodiment, a Cas9 from *Streptococcus pyogenes* is fused to a mitochondrial targeting peptide (MTP), such as a plant MTP sequence; see, e. g., Jores et al. (2016) *Nature Communications,* 7:12036-12051.

Plasmids designed for use in plants and encoding CRISPR genome editing elements (CRISPR nucleases and guide RNAs) are publicly available from plasmid repositories such as Addgene (Cambridge, Mass.; also see "addgen[dot]com") or can be designed using publicly disclosed sequences, e. g., sequences of CRISPR nucleases. In embodiments, such plasmids are used to co-express both CRISPR nuclease mRNA and guide RNA(s); in other embodiments, CRISPR endonuclease mRNA and guide RNA are encoded on separate plasmids. In embodiments, the plasmids are *Agrobacterium* TI plasmids. Materials and methods for preparing expression cassettes and vectors for CRISPR endonuclease and guide RNA for stably integrated and/or transient plant transformation are disclosed in PCT/US2015/018104 (published as WO/2015/131101 and claiming priority to U.S. Provisional Patent Application 61/945,700), U.S. Patent Application Publication 2015/0082478 A1, and PCT/US2015/038767 (published as WO/2016/007347 and claiming priority to U.S. Provisional Patent Application 62/023, 246), all of which are incorporated herein by reference in their entirety. In embodiments, such expression cassettes are isolated linear fragments, or are part of a larger construct that includes bacterial replication elements and selectable markers; such embodiments are useful, e. g., for particle bombardment or nanoparticle delivery or protoplast transformation. In embodiments, the expression cassette is adjacent to or located between T-DNA borders or contained within a binary vector, e. g., for *Agrobacterium*-mediated transformation. In embodiments, a plasmid encoding a CRISPR nuclease is delivered to cell (such as a plant cell or a plant protoplast) for stable integration of the CRISPR nuclease into the genome of cell, or alternatively for transient expression of the CRISPR nuclease. In embodiments, plasmids encoding a CRISPR nuclease are delivered to a plant cell or a plant protoplast to achieve stable or transient expression of the CRISPR nuclease, and one or multiple guide RNAs (such as a library of individual guide RNAs or multiple pooled guide RNAs) or plasmids encoding the guide RNAs are delivered to the plant cell or plant protoplast individually or in combinations, thus providing libraries or arrays of plant cells or plant protoplasts (or of plant callus or whole plants derived therefrom), in which a variety of genome edits are provided by the different guide RNAs. A pool or arrayed collection of diverse modified plant cells comprising subsets of targeted modifications (e.g., a collection of plant cells or plants where some plants are homozygous and some are heterozygous for one, two, three or more targeted modifications) can be compared to determine the function of modified sequences (e.g., mutated or deleted sequences or genes) or the function of sequences being inserted. In other words, the methods and tools described herein can be used to perform "reverse genetics."

In certain embodiments where the genome-editing system is a CRISPR system, expression of the guide RNA is driven by a plant U6 spliceosomal RNA promoter, which can be native to the genome of the plant cell or from a different species, e. g., a U6 promoter from maize, tomato, or soybean such as those disclosed in PCT/US2015/018104 (published as WO 2015/131101 and claiming priority to U.S. Provisional Patent Application 61/945,700), incorporated herein by reference, or a homologue thereof; such a promoter is operably linked to DNA encoding the guide RNA for directing an endonuclease, followed by a suitable 3' element such as a U6 poly-T terminator. In another embodiment, an expression cassette for expressing guide RNAs in plants is used, wherein the promoter is a plant U3, 7SL (signal recognition particle RNA), U2, or U5 promoter, or chimerics thereof, e. g., as described in PCT/US2015/018104 (published as WO 2015/131101 and claiming priority to U.S. Provisional Patent Application 61/945,700), incorporated herein by reference. When multiple or different guide RNA sequences are used, a single expression construct may be used to correspondingly direct the genome editing activity to the multiple or different target sequences in a cell, such a plant cell or a plant protoplast. In various embodiments, a single vector includes 1, 2, 3, 4, 5, 6, 7, 8, 9, 10, about 15, about 20, or more guide RNA sequences; in other embodiments, 1, 2, 3, 4, 5, 6, 7, 8, 9, 10, about 15, about 20, or more guide RNA sequences are provided on multiple vectors, which can be delivered to one or multiple plant cells or plant protoplasts (e. g., delivered to an array of plant cells or plant protoplasts, or to a pooled population of plant cells or plant protoplasts).

In embodiments, one or more guide RNAs and the corresponding RNA-guided nuclease are delivered together or simultaneously. In other embodiments, one or more guide RNAs and the corresponding RNA-guided nuclease are delivered separately; these can be delivered in separate, discrete steps and using the same or different delivery techniques. In an example, an RNA-guided nuclease is delivered to a cell (such as a plant cell or plant protoplast) by particle bombardment, on carbon nanotubes, or by *Agrobacterium*-mediated transformation, and one or more guide RNAs is delivered to the cell in a separate step using the same or different delivery technique. In embodiments, an RNA-guided nuclease encoded by a DNA molecule or an mRNA is delivered to a cell with enough time prior to delivery of the guide RNA to permit expression of the nuclease in the cell; for example, an RNA-guided nuclease encoded by a DNA molecule or an mRNA is delivered to a plant cell or plant protoplast between 1-12 hours (e. g., about 1, 2, 3, 4, 5, 6, 7, 8, 9, 10, 11, or 12 hours, or between about 1-6 hours or between about 2-6 hours) prior to the delivery of the guide RNA to the plant cell or plant protoplast. In embodiments, whether the RNA-guided nuclease is delivered simultaneously with or separately from an initial dose of guide RNA, succeeding "booster" doses of guide RNA are delivered subsequent to the delivery of the initial dose; for example, a second "booster" dose of guide RNA is delivered to a plant cell or plant protoplast between 1-12 hours (e. g., about 1, 2, 3, 4, 5, 6, 7, 8, 9, 10, 11, or 12 hours, or between about 1-6 hours or between about 2-6 hours) subsequent to the delivery of the initial dose of guide RNA to the plant cell or plant protoplast. Similarly, in some embodiments, multiple deliveries of an RNA-guided nuclease or of a DNA molecule or an mRNA encoding an RNA-guided nuclease are used to increase efficiency of the genome modification.

In embodiments, the desired genome modification involves non-homologous recombination, in this case non-homologous end-joining of genomic sequence across one or more introduced double-strand breaks; generally, such embodiments do not require a donor template having homology "arms" (regions of homologous or complimentary sequence to genomic sequence flanking the site of the DSB). In various embodiments described herein, donor polynucleotides encoding sequences for targeted insertion at double-stranded breaks are single-stranded polynucleotides comprising RNA or DNA or both types of nucleotides; or the donor polynucleotides are at least partially double-stranded and comprise RNA, DNA or both types of nucleotides. Other modified nucleotides may also be used.

In other embodiments, the desired genome modification involves homologous recombination, wherein one or more double-stranded DNA break in the target nucleotide sequence is generated by the RNA-guided nuclease and guide RNA(s), followed by repair of the break(s) using a homologous recombination mechanism ("homology-directed repair"). In such embodiments, a donor template that encodes the desired nucleotide sequence to be inserted or knocked-in at the double-stranded break and generally having homology "arms" (regions of homologous or complimentary sequence to genomic sequence flanking the site of the DSB) is provided to the cell (such as a plant cell or plant protoplast); examples of suitable templates include single-stranded DNA templates and double-stranded DNA templates (e. g., in the form of a plasmid). In general, a donor template encoding a nucleotide change over a region of less than about 50 nucleotides is conveniently provided in the form of single-stranded DNA; larger donor templates (e. g., more than 100 nucleotides) are often conveniently provided as double-stranded DNA plasmids.

In certain embodiments directed to the targeted incorporation of sequences by homologous recombination, a donor template has a core nucleotide sequence that differs from the target nucleotide sequence (e. g., a homologous endogenous genomic region) by at least 1, at least 5, at least 10, at least 20, at least 30, at least 40, at least 50, or more nucleotides. This core sequence is flanked by "homology arms" or regions of high sequence identity with the targeted nucleotide sequence; in embodiments, the regions of high identity include at least 10, at least 50, at least 100, at least 150, at least 200, at least 300, at least 400, at least 500, at least 600, at least 750, or at least 1000 nucleotides on each side of the core sequence. In embodiments where the donor template is in the form of a single-stranded DNA, the core sequence is flanked by homology arms including at least 10, at least 20, at least 30, at least 40, at least 50, at least 60, at least 70, at least 80, or at least 100 nucleotides on each side of the core sequence. In embodiments where the donor template is in the form of a double-stranded DNA plasmid, the core sequence is flanked by homology arms including at least 500, at least 600, at least 700, at least 800, at least 900, or at least 1000 nucleotides on each side of the core sequence. In an embodiment, two separate double-strand breaks are introduced into the cell's target nucleotide sequence with a "double nickase" Cas9 (see Ran et al. (2013) *Cell*, 154: 1380-1389), followed by delivery of the donor template.

Delivery Methods and Agents

Aspects of the invention involve various treatments employed to deliver to a plant cell or protoplast a guide RNA (gRNA), such as a crRNA or sgRNA (or a polynucleotide encoding such), and/or a polynucleotide encoding a sequence for targeted insertion at a double-strand break in a genome. In embodiments, one or more treatments are employed to deliver the gRNA into a plant cell or plant protoplast, e. g., through barriers such as a cell wall or a plasma membrane or nuclear envelope or other lipid bilayer.

Unless otherwise stated, the various compositions and methods described herein for delivering guide RNAs and nucleases to a plant cell or protoplast are also generally useful for delivering donor polynucleotides to the cell. The delivery of donor polynucleotides can be simultaneous with, or separate from (generally after) delivery of the nuclease and guide RNA to the cell. For example, a donor polynucleotide can be transiently introduced into a plant cell or plant protoplast, optionally with the nuclease and/or gRNA; in certain embodiments, the donor template is provided to the plant cell or plant protoplast in a quantity that is sufficient to achieve the desired insertion of the donor polynucleotide sequence but donor polynucleotides do not persist in the plant cell or plant protoplast after a given period of time (e. g., after one or more cell division cycles).

In certain embodiments, a gRNA- or donor polynucleotide, in addition to other agents involved in targeted modifications, can be delivered to a plant cell or protoplast by directly contacting the plant cell or protoplast with a composition comprising the gRNA(s) or donor polynucleotide(s). For example, a gRNA-containing composition in the form of a liquid, a solution, a suspension, an emulsion, a reverse emulsion, a colloid, a dispersion, a gel, liposomes, micelles, an injectable material, an aerosol, a solid, a powder, a particulate, a nanoparticle, or a combination thereof can be applied directly to a plant cell (or plant part or tissue containing the plant cell) or plant protoplast (e. g., through abrasion or puncture or otherwise disruption of the cell wall or cell membrane, by spraying or dipping or soaking or otherwise directly contacting, or by microinjection). In certain embodiments, a plant cell (or plant part or tissue containing the plant cell) or plant protoplast is soaked in a liquid gRNA-containing composition, whereby the gRNA is delivered to the plant cell or plant protoplast. In embodiments, the gRNA-containing composition is delivered using negative or positive pressure, for example, using vacuum infiltration or application of hydrodynamic or fluid pressure. In embodiments, the gRNA-containing composition is introduced into a plant cell or plant protoplast, e. g., by microinjection or by disruption or deformation of the cell wall or cell membrane, for example by physical treatments such as by application of negative or positive pressure, shear forces, or treatment with a chemical or physical delivery agent such as surfactants, liposomes, or nanoparticles; see, e. g., delivery of materials to cells employing microfluidic flow through a cell-deforming constriction as described in US Published Patent Application 2014/0287509, incorporated by reference in its entirety herein. Other techniques useful for delivering the gRNA-containing composition to a plant cell or plant protoplast include: ultrasound or sonication; vibration, friction, shear stress, vortexing, cavitation; centrifugation or application of mechanical force; mechanical cell wall or cell membrane deformation or breakage; enzymatic cell wall or cell membrane breakage or permeabilization; abrasion or mechanical scarification (e. g., abrasion with carborundum or other particulate abrasive or scarification with a file or sandpaper) or chemical scarification (e. g., treatment with an acid or caustic agent); and electroporation. In embodiments, the gRNA-containing composition is provided by bacterially mediated (e. g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection of the plant cell or plant protoplast with a polynucleotide encoding the gRNA; see, e. g., Broothaerts et al. (2005) *Nature*, 433:629-633. Any of these techniques or a combination thereof are alternatively employed on the plant part or tissue or intact plant (or seed) from which a plant cell or plant protoplast is optionally subsequently obtained or isolated; in embodiments, the gRNA-containing composition is delivered in a separate step after the plant cell or plant protoplast has been obtained or isolated.

In embodiments, a treatment employed in delivery of a gRNA to a plant cell or plant protoplast is carried out under a specific thermal regime, which can involve one or more appropriate temperatures, e. g., chilling or cold stress (exposure to temperatures below that at which normal plant growth occurs), or heating or heat stress (exposure to temperatures above that at which normal plant growth occurs), or treating at a combination of different temperatures. In embodiments, a specific thermal regime is carried out on the plant cell or plant protoplast, or on a plant or plant part from which a plant cell or plant protoplast is subsequently obtained or isolated, in one or more steps separate from the gRNA delivery.

In embodiments, a whole plant or plant part or seed, or an isolated plant cell or plant protoplast, or the plant or plant part from which a plant cell or plant protoplast is obtained or isolated, is treated with one or more delivery agents which can include at least one chemical, enzymatic, or physical agent, or a combination thereof. In embodiments, a gRNA-containing composition further includes one or more chemical, enzymatic, or physical agent for delivery. In embodiments that further include the step of providing an RNA-guided nuclease or a polynucleotide that encodes the RNA-guided nuclease, a gRNA-containing composition including the RNA-guided nuclease or polynucleotide that encodes the RNA-guided nuclease further includes one or more one chemical, enzymatic, or physical agent for delivery. Treatment with the chemical, enzymatic or physical agent can be carried out simultaneously with the gRNA delivery, with the RNA-guided nuclease delivery, or in one or more separate steps that precede or follow the gRNA delivery or the RNA-guided nuclease delivery. In embodiments, a chemical, enzymatic, or physical agent, or a combination of these, is associated or complexed with the polynucleotide composition, with the gRNA or polynucleotide that encodes or is processed to the gRNA, or with the RNA-guided nuclease or polynucleotide that encodes the RNA-guided nuclease; examples of such associations or complexes include those involving non-covalent interactions (e. g., ionic or electrostatic interactions, hydrophobic or hydrophilic interactions, formation of liposomes, micelles, or other heterogeneous composition) and covalent interactions (e. g., peptide bonds, bonds formed using cross-linking agents). In non-limiting examples, a gRNA or polynucleotide that encodes or is processed to the gRNA is provided as a liposomal complex with a cationic lipid; a gRNA or polynucleotide that encodes or is processed to the gRNA is provided as a complex with a carbon nanotube; and an RNA-guided nuclease is provided as a fusion protein between the nuclease and a cell-penetrating peptide. Examples of agents useful for delivering a gRNA or polynucleotide that encodes or is processed to the gRNA or a nuclease or polynucleotide that encodes the nuclease include the various cationic liposomes and polymer nanoparticles reviewed by Zhang et al. (2007) *J. Controlled Release*, 123:1-10, and the cross-linked multimellar liposomes described in U.S. Patent Application Publication 2014/0356414 A1, incorporated by reference in its entirety herein.

In embodiments, the chemical agent is at least one selected from the group consisting of:

(a) solvents (e. g., water, dimethylsulfoxide, dimethylformamide, acetonitrile, N-pyrrolidine, pyridine, hexamethylphosphoramide, alcohols, alkanes, alkenes, dioxanes, polyethylene glycol, and other solvents miscible or emulsifiable with water or that will dissolve phosphonucleotides in non-aqueous systems);

(b) fluorocarbons (e. g., perfluorodecalin, perfluoromethyldecalin);

(c) glycols or polyols (e. g., propylene glycol, polyethylene glycol);

(d) surfactants, including cationic surfactants, anionic surfactants, non-ionic surfactants, and amphiphilic surfactants, e. g., alkyl or aryl sulfates, phosphates, sulfonates, or carboxylates; primary, secondary, or tertiary amines; quaternary ammonium salts; sultaines, betaines; cationic lipids; phospholipids; tallowamine; bile acids such as cholic acid; long chain alcohols; organosilicone surfactants including nonionic organosilicone surfactants such as trisiloxane ethoxylate surfactants or a silicone polyether copolymer such as a copolymer of polyalkylene oxide modified heptamethyl trisiloxane and allyloxypolypropylene glycol methylether (commercially available as SILWET L-77™ brand surfactant having CAS Number 27306-78-1 and EPA Number CAL. REG. NO. 5905-50073-AA, Momentive Performance Materials, Inc., Albany, N.Y.); specific examples of useful surfactants include sodium lauryl sulfate, the Tween series of surfactants, Triton-X100, Triton-X114, CHAPS and CHAPSO, Tergitol-type NP-40, Nonidet P-40;

(e) lipids, lipoproteins, lipopolysaccharides;

(f) acids, bases, caustic agents;

(g) peptides, proteins, or enzymes (e. g., cellulase, pectolyase, macroenzyme, pectinase), including cell-penetrating or pore-forming peptides (e. g., (BO100)2K8, Genscript; poly-lysine, poly-arginine, or poly-homoarginine peptides; gamma zein, see U.S. Patent Application publication 2011/0247100, incorporated herein by reference in its entirety; transcription activator of human immunodeficiency virus type 1 ("HIV-1 Tat") and other Tat proteins, see, e. g., www[dot]lifetein[dot]com/Cell_Penetrating_Peptides[dot]html and Järver (2012) *Mol. Therapy—Nucleic Acids,* 1:e27, 1-17); octa-arginine or nona-arginine; poly-homoarginine (see Unnamalai et al. (2004) *FEBS Letters,* 566:307-310); see also the database of cell-penetrating peptides CPPsite 2.0 publicly available at crdd[dot]osdd[dot]net/raghava/cppsite/(h)

(h) RNase inhibitors;

(i) cationic branched or linear polymers such as chitosan, poly-lysine, DEAE-dextran, polyvinylpyrrolidone ("PVP"), or polyethylenimine ("PEI", e. g., PEI, branched, MW 25,000, CAS #9002-98-6; PEI, linear, MW 5000, CAS #9002-98-6; PEI linear, MW 2500, CAS #9002-98-6);

(j) dendrimers (see, e. g., U.S. Patent Application Publication 2011/0093982, incorporated herein by reference in its entirety);

(k) counter-ions, amines or polyamines (e. g., spermine, spermidine, putrescine), osmolytes, buffers, and salts (e. g., calcium phosphate, ammonium phosphate);

(l) polynucleotides (e. g., non-specific double-stranded DNA, salmon sperm DNA);

(m) transfection agents (e. g., Lipofectin®, Lipofectamine®, and Oligofectamine®, and Invivofectamine® (all from Thermo Fisher Scientific, Waltham, Mass.), PepFect (see Ezzat et al. (2011) *Nucleic Acids Res.,* 39:5284-5298), TransIt® transfection reagents (Mirus Bio, LLC, Madison, Wis.), and poly-lysine, poly-homoarginine, and poly-arginine molecules including octo-arginine and nonoarginine as described in Lu et al. (2010) *J. Agric. Food Chem.,* 58:2288-2294);

(n) antibiotics, including non-specific DNA double-strand-break-inducing agents (e. g., phleomycin, bleomycin, talisomycin); and (o) antioxidants (e. g., glutathione, dithiothreitol, ascorbate).

In embodiments, the chemical agent is provided simultaneously with the gRNA (or polynucleotide encoding the gRNA or that is processed to the gRNA), for example, the polynucleotide composition including the gRNA further includes one or more chemical agent. In embodiments, the gRNA or polynucleotide encoding the gRNA or that is processed to the gRNA is covalently or non-covalently linked or complexed with one or more chemical agent; for example, the gRNA or polynucleotide encoding the gRNA or that is processed to the gRNA can be covalently linked to a peptide or protein (e. g., a cell-penetrating peptide or a pore-forming peptide) or non-covalently complexed with cationic lipids, polycations (e. g., polyamines), or cationic polymers (e. g., PEI). In embodiments, the gRNA or polynucleotide encoding the gRNA or that is processed to the gRNA is complexed with one or more chemical agents to form, e. g., a solution, liposome, micelle, emulsion, reverse emulsion, suspension, colloid, or gel.

In embodiments, the physical agent is at least one selected from the group consisting of particles or nanoparticles (e. g., particles or nanoparticles made of materials such as carbon, silicon, silicon carbide, gold, tungsten, polymers, or ceramics) in various size ranges and shapes, magnetic particles or nanoparticles (e. g., silenceMag Magnetotransfection™ agent, OZ Biosciences, San Diego, Calif.), abrasive or scarifying agents, needles or microneedles, matrices, and grids. In embodiments, particulates and nanoparticulates are useful in delivery of the polynucleotide composition or the nuclease or both. Useful particulates and nanoparticles include those made of metals (e. g., gold, silver, tungsten, iron, cerium), ceramics (e. g., aluminum oxide, silicon carbide, silicon nitride, tungsten carbide), polymers (e. g., polystyrene, polydiacetylene, and poly(3,4-ethylenedioxythiophene) hydrate), semiconductors (e. g., quantum dots), silicon (e. g., silicon carbide), carbon (e. g., graphite, graphene, graphene oxide, or carbon nanosheets, nanocomplexes, or nanotubes), and composites (e. g., polyvinylcarbazole/graphene, polystyrene/graphene, platinum/graphene, palladium/graphene nanocomposites). In embodiments, such particulates and nanoparticulates are further covalently or non-covalently functionalized, or further include modifiers or cross-linked materials such as polymers (e. g., linear or branched polyethylenimine, poly-lysine), polynucleotides (e. g., DNA or RNA), polysaccharides, lipids, polyglycols (e. g., polyethylene glycol, thiolated polyethylene glycol), polypeptides or proteins, and detectable labels (e. g., a fluorophore, an antigen, an antibody, or a quantum dot). In various embodiments, such particulates and nanoparticles are neutral, or carry a positive charge, or carry a negative charge. Embodiments of compositions including particulates include those formulated, e. g., as liquids, colloids, dispersions, suspensions, aerosols, gels, and solids. Embodiments include nanoparticles affixed to a surface or support, e. g., an array of carbon nanotubes vertically aligned on a silicon or copper wafer substrate. Embodiments include polynucleotide compositions including particulates (e. g., gold or tungsten or magnetic particles) delivered by a Biolistic-type technique or with magnetic force. The size of the particles used in Biolistics is generally in the "microparticle" range, for example, gold microcarriers in the 0.6, 1.0, and 1.6 micrometer size ranges (see, e. g., instruction manual for the Helios® Gene Gun System, Bio-Rad, Hercules, Calif.; Randolph-Anderson et al. (2015) "Sub-micron gold particles are superior to larger particles for efficient Biolistic® transformation of organelles and some cell types", Bio-Rad US/EG Bulletin 2015), but successful Biolistics delivery using larger (40 nanometer) nanoparticles has been reported in cultured animal cells; see O'Brian and Lummis (2011) *BMC Biotechnol.*, 11:66-71. Other embodiments of useful particulates are nanoparticles, which are generally in the nanometer (nm) size range or less than 1 micrometer, e. g., with a diameter of less than about 1 nm, less than about 3 nm, less than about 5 nm, less than about 10 nm, less than about 20 nm, less than about 40 nm, less than about 60 nm, less than about 80 nm, and less than about 100 nm. Specific, non-limiting embodiments of nanoparticles commercially available (all from Sigma-Aldrich Corp., St. Louis, Mo.) include gold nanoparticles with diameters of 5, 10, or 15 nm; silver nanoparticles with particle sizes of 10, 20, 40, 60, or 100 nm; palladium "nanopowder" of less than 25 nm particle size; single-, double-, and multi-walled carbon nanotubes, e. g., with diameters of 0.7-1.1, 1.3-2.3, 0.7-0.9, or 0.7-1.3 nm, or with nanotube bundle dimensions of 2-10 nm by 1-5 micrometers, 6-9 nm by 5 micrometers, 7-15 nm by 0.5-10 micrometers, 7-12 nm by 0.5-10 micrometers, 110-170 nm by 5-9 micrometers, 6-13 nm by 2.5-20 micrometers. Embodiments include polynucleotide compositions including materials such as gold, silicon, cerium, or carbon, e. g., gold or gold-coated nanoparticles, silicon carbide whiskers, carborundum, porous silica nanoparticles, gelatin/silica nanoparticles, nanoceria or cerium oxide nanoparticles (CNPs), carbon nanotubes (CNTs) such as single-, double-, or multi-walled carbon nanotubes and their chemically functionalized versions (e. g., carbon nanotubes functionalized with amide, amino, carboxylic acid, sulfonic acid, or polyethylene glycol moieties), and graphene or graphene oxide or graphene complexes; see, for example, Wong et al. (2016) *Nano Lett.*, 16:1161-1172; Giraldo et al. (2014) *Nature Materials*, 13:400-409; Shen et al. (2012) *Theranostics*, 2:283-294; Kim et al. (2011) *Bioconjugate Chem.*, 22:2558-2567; Wang et al. (2010) *J. Am. Chem. Soc. Comm.*, 132: 9274-9276; Zhao et al. (2016) *Nanoscale Res. Lett.*, 11:195-203; and Choi et al. (2016) *J. Controlled Release*, 235:222-235. See also, for example, the various types of particles and nanoparticles, their preparation, and methods for their use, e. g., in delivering polynucleotides and polypeptides to cells, disclosed in U.S. Patent Application Publications 2010/0311168, 2012/0023619, 2012/0244569, 2013/0145488, 2013/0185823, 2014/0096284, 2015/0040268, 2015/0047074, and 2015/0208663, all of which are incorporated herein by reference in their entirety.

In embodiments wherein the gRNA (or polynucleotide encoding the gRNA) is provided in a composition that further includes an RNA-guided nuclease (or a polynucleotide that encodes the RNA-guided nuclease), or wherein the method further includes the step of providing an RNA-guided nuclease or a polynucleotide that encodes the RNA-guided nuclease, one or more one chemical, enzymatic, or physical agent can similarly be employed. In embodiments, the RNA-guided nuclease (or polynucleotide encoding the RNA-guided nuclease) is provided separately, e. g., in a separate composition including the RNA-guided nuclease or polynucleotide encoding the RNA-guided nuclease. Such compositions can include other chemical or physical agents (e. g., solvents, surfactants, proteins or enzymes, transfection agents, particulates or nanoparticulates), such as those described above as useful in the polynucleotide composition used to provide the gRNA. For example, porous silica nanoparticles are useful for delivering a DNA recombinase into maize cells; see, e. g., Martin-Ortigosa et al. (2015) *Plant Physiol.*, 164:537-547. In an embodiment, the polynucleotide composition includes a gRNA and Cas9 nuclease, and further includes a surfactant and a cell-penetrating peptide. In an embodiment, the polynucleotide composition includes a plasmid that encodes both an RNA-guided nuclease and at least on gRNA, and further includes a surfactant and carbon nanotubes. In an embodiment, the polynucleotide composition includes multiple gRNAs and an mRNA encoding the RNA-guided nuclease, and further includes gold particles, and the polynucleotide composition is delivered to a plant cell or plant protoplast by Biolistics.

In related embodiments, one or more one chemical, enzymatic, or physical agent can be used in one or more steps separate from (preceding or following) that in which the gRNA is provided. In an embodiment, the plant or plant part from which a plant cell or plant protoplast is obtained or isolated is treated with one or more one chemical, enzymatic, or physical agent in the process of obtaining or isolating the plant cell or plant protoplast. In embodiments, the plant or plant part is treated with an abrasive, a caustic agent, a surfactant such as Silwet L-77 or a cationic lipid, or an enzyme such as cellulase.

In embodiments, a gRNA is delivered to plant cells or plant protoplasts prepared or obtained from a plant, plant part, or plant tissue that has been treated with the polynucleotide compositions (and optionally the nuclease). In embodiments, one or more one chemical, enzymatic, or physical agent, separately or in combination with the polynucleotide composition, is provided/applied at a location in the plant or plant part other than the plant location, part, or tissue from which the plant cell or plant protoplast is obtained or isolated. In embodiments, the polynucleotide composition is applied to adjacent or distal cells or tissues and is transported (e. g., through the vascular system or by cell-to-cell movement) to the meristem from which plant cells or plant protoplasts are subsequently isolated. In embodiments, a gRNA-containing composition is applied by soaking a seed or seed fragment or zygotic or somatic embryo in the gRNA-containing composition, whereby the gRNA is delivered to the seed or seed fragment or zygotic or somatic embryo from which plant cells or plant protoplasts are subsequently isolated. In embodiments, a flower bud or shoot tip is contacted with a gRNA-containing composition, whereby the gRNA is delivered to cells in the flower bud or shoot tip from which plant cells or plant protoplasts are subsequently isolated. In embodiments, a gRNA-containing composition is applied to the surface of a plant or of a part of a plant (e. g., a leaf surface), whereby the gRNA is delivered to tissues of the plant from which plant cells or plant protoplasts are subsequently isolated. In embodiments a whole plant or plant tissue is subjected to particle- or nanoparticle-mediated delivery (e. g., Biolistics or carbon nanotube or nanoparticle delivery) of a gRNA-containing composition, whereby the gRNA is delivered to cells or tissues from which plant cells or plant protoplasts are subsequently isolated.

Methods of Modulating Expression of a Sequence of Interest in a Genome

In one aspect, the invention provides a method of changing expression of a sequence of interest in a genome, including integrating a sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. The method permits site-specific integration of heterologous sequence at the site of at least one DSB, and thus at one or more locations in a genome, such as a genome of a plant cell. In embodiments, the genome is that of a nucleus, mitochondrion, or plastid in a plant cell.

By "integration of heterologous sequence" is meant integration or insertion of one or more nucleotides, resulting in a sequence (including the inserted nucleotide(s) as well as at least some adjacent nucleotides of the genomic sequence flanking the site of insertion at the DSB) that is heterologous, i. e., would not otherwise or does not normally occur at the site of insertion. (The term "heterologous" is also used to refer to a given sequence in relationship to another—e. g., the sequence of the polynucleotide donor molecule is heterologous to the sequence at the site of the DSB wherein the polynucleotide is integrated.)

The at least one DSB is introduced into the genome by any suitable technique; in embodiments one or more DSBs is introduced into the genome in a site- or sequence-specific manner, for example, by use of at least one of the group of DSB-inducing agents consisting of: (a) a nuclease capable of effecting site-specific alteration of a target nucleotide sequence, selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease; (b) a polynucleotide encoding one or more nucleases capable of effecting site-specific alteration (such as introduction of a DSB) of a target nucleotide sequence; and (c) a guide RNA (gRNA) for an RNA-guided nuclease, or a DNA encoding a gRNA for an RNA-guided nuclease. In embodiments, one or more DSBs is introduced into the genome by use of both a guide RNA (gRNA) and the corresponding RNA-guided nuclease. In an example, one or more DSBs is introduced into the genome by use of a ribonucleoprotein (RNP) that includes both a gRNA (e. g., a single-guide RNA or sgRNA that includes both a crRNA and a tracrRNA) and a Cas9. It is generally desirable that the sequence encoded by the polynucleotide donor molecule is integrated at the site of the DSB at high efficiency. One measure of efficiency is the percentage or fraction of the population of cells that have been treated with a DSB-inducing agent and polynucleotide donor molecule, and in which a sequence encoded by the polynucleotide donor molecule is successfully introduced at the DSB correctly located in the genome. The efficiency of genome editing including integration of a sequence encoded by a polynucleotide donor molecule at a DSB in the genome is assessed by any suitable method such as a heteroduplex cleavage assay or by sequencing, as described elsewhere in this disclosure. In various embodiments, the DSB is induced in the correct location in the genome at a comparatively high efficiency, e. g., at about 10, about 15, about 20, about 30, about 40, about 50, about 60, about 70, or about 80 percent efficiency, or at greater than 80, 85, 90, or 95 percent efficiency (measured as the percentage of the total population of cells in which the DSB is induced at the correct location in the genome). In various embodiments, a sequence encoded by the polynucleotide donor molecule is integrated at the site of the DSB at a comparatively high efficiency, e. g., at about 10, about 15, about 20, about 30, about 40, about 50, about 60, about 70, or about 80 percent efficiency, or at greater than 80, 85, 90, or 95 percent efficiency (measured as the percentage of the total population of cells in which the polynucleotide molecule is integrated at the site of the DSB in the correct location in the genome).

Apart from the CRISPR-type nucleases, other nucleases capable of effecting site-specific alteration of a target nucleotide sequence include zinc-finger nucleases (ZFNs), transcription activator-like effector nucleases (TAL-effector nucleases or TALENs), Argonaute proteins, and a meganuclease or engineered meganuclease. Zinc finger nucleases (ZFNs) are engineered proteins comprising a zinc finger DNA-binding domain fused to a nucleic acid cleavage domain, e. g., a nuclease. The zinc finger binding domains provide specificity and can be engineered to specifically recognize any desired target DNA sequence. For a review of the construction and use of ZFNs in plants and other organisms, see, e. g., Urnov et al. (2010) *Nature Rev. Genet.,* 11:636-646. The zinc finger DNA binding domains are derived from the DNA-binding domain of a large class of eukaryotic transcription factors called zinc finger proteins (ZFPs). The DNA-binding domain of ZFPs typically contains a tandem array of at least three zinc "fingers" each recognizing a specific triplet of DNA. A number of strategies can be used to design the binding specificity of the zinc finger binding domain. One approach, termed "modular assembly", relies on the functional autonomy of individual zinc fingers with DNA. In this approach, a given sequence is targeted by identifying zinc fingers for each component triplet in the sequence and linking them into a multifinger peptide. Several alternative strategies for designing zinc finger DNA binding domains have also been developed. These methods are designed to accommodate the ability of zinc fingers to contact neighboring fingers as well as nucleotides bases outside their target triplet. Typically, the engineered zinc finger DNA binding domain has a novel binding specificity, compared to a naturally-occurring zinc finger protein. Modification methods include, for example, rational design and various types of selection. Rational design includes, for example, the use of databases of triplet (or quadruplet) nucleotide sequences and individual zinc finger amino acid sequences, in which each triplet or quadruplet nucleotide sequence is associated with one or more amino acid sequences of zinc fingers which bind the particular triplet or quadruplet sequence. See, e. g., U.S. Pat. Nos. 6,453,242 and 6,534,261, both incorporated herein by reference in their entirety. Exemplary selection methods (e. g., phage display and yeast two-hybrid systems) are well known and described in the literature. In addition, enhancement of binding specificity for zinc finger binding domains has been described in U.S. Pat. No. 6,794,136, incorporated herein by reference in its entirety. In addition, individual zinc finger domains may be linked together using any suitable linker sequences. Examples of linker sequences are publicly known, e. g., see U.S. Pat. Nos. 6,479,626; 6,903,185; and 7,153,949, incorporated herein by reference in their entirety. The nucleic acid cleavage domain is non-specific and is typically a restriction endonuclease, such as FoId. This endonuclease must dimerize to cleave DNA. Thus, cleavage by FoId as part of a ZFN requires two adjacent and independent binding events, which must occur in both the correct orientation and with appropriate spacing to permit dimer formation. The requirement for two DNA binding events enables more specific targeting of long and potentially unique recognition sites. FoId variants with enhanced activities have been described; see, e. g., Guo et al. (2010) *J. Mol. Biol.,* 400:96-107.

Transcription activator like effectors (TALEs) are proteins secreted by certain *Xanthomonas* species to modulate gene expression in host plants and to facilitate the colonization by and survival of the bacterium. TALEs act as transcription factors and modulate expression of resistance genes in the plants. Recent studies of TALEs have revealed the code linking the repetitive region of TALEs with their target DNA-binding sites. TALEs comprise a highly conserved and repetitive region consisting of tandem repeats of mostly 33 or 34 amino acid segments. The repeat monomers differ from each other mainly at amino acid positions 12 and 13. A strong correlation between unique pairs of amino acids at positions 12 and 13 and the corresponding nucleotide in the TALE-binding site has been found. The simple relationship between amino acid sequence and DNA recognition of the TALE binding domain allows for the design of DNA binding domains of any desired specificity. TALEs can be linked to a non-specific DNA cleavage domain to prepare genome editing proteins, referred to as TAL-effector nucleases or TALENs. As in the case of ZFNs, a restriction endonuclease, such as FoId, can be conveniently used. For a description of the use of TALENs in plants, see Mahfouz et al. (2011) *Proc. Natl. Acad. Sci. USA,* 108:2623-2628 and Mahfouz (2011) *GM Crops,* 2:99-103.

Argonauts are proteins that can function as sequence-specific endonucleases by binding a polynucleotide (e. g., a single-stranded DNA or single-stranded RNA) that includes sequence complementary to a target nucleotide sequence) that guides the Argonaut to the target nucleotide sequence and effects site-specific alteration of the target nucleotide sequence; see, e. g., U.S. Patent Application Publication 2015/0089681, incorporated herein by reference in its entirety.

Another method of effecting targeted changes to a genome is the use of triple-forming peptide nucleic acids (PNAs) designed to bind site-specifically to genomic DNA via strand invasion and the formation of PNA/DNA/PNA triplexes (via both Watson-Crick and Hoogsteen binding) with a displaced DNA strand. PNAs consist of a charge neutral peptide-like backbone and nucleobases. The nucleobases hybridize to DNA with high affinity. The triplexes then recruit the cell's endogenous DNA repair systems to initiate site-specific modification of the genome. The desired sequence modification is provided by single-stranded 'donor DNAs' which are co-delivered as templates for repair. See, e. g., Bahal R et al (2016) *Nature Communications,* Oct. 26, 2016.

In related embodiments, zinc finger nucleases, TALENs, and Argonautes are used in conjunction with other functional domains. For example, the nuclease activity of these nucleic acid targeting systems can be altered so that the enzyme binds to but does not cleave the DNA. Examples of functional domains include transposase domains, integrase domains, recombinase domains, resolvase domains, invertase domains, protease domains, DNA methyltransferase domains, DNA hydroxylmethylase domains, DNA demethylase domains, histone acetylase domains, histone deacetylase domains, nuclease domains, repressor domains, activator domains, nuclear-localization signal domains, transcription-regulatory protein (or transcription complex recruiting) domains, cellular uptake activity associated domains, nucleic acid binding domains, antibody presentation domains, histone modifying enzymes, recruiter of histone modifying enzymes; inhibitor of histone modifying enzymes, histone methyltransferases, histone demethylases, histone kinases, histone phosphatases, histone ribosylases, histone deribosylases, histone ubiquitinases, histone deubiquitinases, histone biotinases and histone tail proteases. Non-limiting examples of functional domains include a transcriptional activation domain, a transcription repression domain, and an SHH1, SUVH2, or SUVH9 polypeptide capable of reducing expression of a target nucleotide sequence via epigenetic modification; see, e. g., U.S. Patent Application Publication 2016/0017348, incorporated herein by reference in its entirety. Genomic DNA may also be modified via base editing using a fusion between a catalytically inactive Cas9 (dCas9) is fused to a cytidine deaminase which convert cytosine (C) to uridine (U), thereby effecting a C to T substitution; see Komor et al. (2016) *Nature*, 533:420-424.

In embodiments, the guide RNA (gRNA) has a sequence of between 16-24 nucleotides in length (e. g., 16, 17, 18, 19, 20, 21, 22, 23, or 24 nucleotides in length). Specific embodiments include gRNAs of 19, 20, or 21 nucleotides in length and having 100% complementarity to the target nucleotide sequence. In many embodiments the gRNA has exact complementarity (i. e., perfect base-pairing) to the target nucleotide sequence; in certain other embodiments the gRNA has less than 100% complementarity to the target nucleotide sequence. The design of effective gRNAs for use in plant genome editing is disclosed in U.S. Patent Application Publication 2015/0082478 A1, the entire specification of which is incorporated herein by reference. In embodiments where multiple gRNAs are employed, the multiple gRNAs can be delivered separately (as separate RNA molecules or encoded by separate DNA molecules) or in combination, e. g., as an RNA molecule containing multiple gRNA sequences, or as a DNA molecule encoding an RNA molecule containing multiple gRNA sequences; see, for example, U.S. Patent Application Publication 2016/0264981 A1, the entire specification of which is incorporated herein by reference, which discloses RNA molecules including multiple RNA sequences (such as gRNA sequences) separated by tRNA cleavage sequences. In other embodiments, a DNA molecule encodes multiple gRNAs which are separated by other types of cleavable transcript, for example, small RNA (e. g., miRNA, siRNA, or ta-siRNA) recognition sites which can be cleaved by the corresponding small RNA, or dsRNA-forming regions which can be cleaved by a Dicer-type ribonuclease, or sequences which are recognized by RNA nucleases such as Cys4 ribonuclease from *Pseudomonas aeruginosa*; see, e. g., U.S. Pat. No. 7,816,581, the entire specification of which is incorporated herein by reference, which discloses in FIG. 27 and elsewhere in the specification pol II promoter-driven DNA constructs encoding RNA transcripts that are released by cleavage. Efficient Cas9-mediated gene editing has been achieved using a chimeric "single guide RNA" ("sgRNA"), an engineered (synthetic) single RNA molecule that mimics a naturally occurring crRNA-tracrRNA complex and contains both a tracrRNA (for binding the nuclease) and at least one crRNA (to guide the nuclease to the sequence targeted for editing). In other embodiments, self-cleaving ribozyme sequences can be used to separate multiple gRNA sequences within a transcript.

Thus, in certain embodiments wherein the nuclease is a Cas9-type nuclease, the gRNA can be provided as a polynucleotide composition including: (a) a CRISPR RNA (crRNA) that includes the gRNA together with a separate tracrRNA, or (b) at least one polynucleotide that encodes a crRNA and a tracrRNA (on a single polynucleotide or on separate polynucleotides), or (c) at least one polynucleotide that is processed into one or more crRNAs and a tracrRNA. In other embodiments wherein the nuclease is a Cas9-type nuclease, the gRNA can be provided as a polynucleotide composition including a CRISPR RNA (crRNA) that includes the gRNA, and the required tracrRNA is provided in a separate composition or in a separate step, or is otherwise provided to the cell (for example, to a plant cell or plant protoplast that stably or transiently expresses the tracrRNA from a polynucleotide encoding the tracrRNA). In other embodiments wherein the nuclease is a Cas9-type nuclease, the gRNA can be provided as a polynucleotide composition comprising: (a) a single guide RNA (sgRNA) that includes the gRNA, or (b) a polynucleotide that encodes a sgRNA, or (c) a polynucleotide that is processed into a sgRNA. Cpf1-mediated gene editing does not require a tracrRNA; thus, in embodiments wherein the nuclease is a Cpf1-type nuclease, the gRNA is provided as a polynucleotide composition comprising (a) a CRISPR RNA (crRNA) that includes the gRNA, or (b) a polynucleotide that encodes a crRNA, or (c) a polynucleotide that is processed into a crRNA. In embodiments, the gRNA-containing composition optionally includes an RNA-guided nuclease, or a polynucleotide that encodes the RNA-guided nuclease. In other embodiments, an RNA-guided nuclease or a polynucleotide that encodes the RNA-guided nuclease is provided in a separate step. In some embodiments of the method, a gRNA is provided to a cell (e. g., a plant cell or plant protoplast) that includes an RNA-guided nuclease or a polynucleotide that encodes an RNA-guided nuclease, e. g., an RNA-guided nuclease selected from the group consisting of an RNA-guided DNA endonuclease, a type II Cas nuclease, a Cas9, a type V Cas nuclease, a Cpf1, a CasY, a CasX, a C2c1, a C2c3, an engineered RNA-guided nuclease, and a codon-optimized RNA-guided nuclease; in an example, the cell (e. g., a plant cell or plant protoplast) stably or transiently expresses the RNA-guided nuclease. In embodiments, the polynucleotide that encodes the RNA-guided nuclease is, for example, DNA that encodes the RNA-guided nuclease and is stably integrated in the genome of a plant cell or plant protoplast, DNA or RNA that encodes the RNA-guided nuclease and is transiently present in or introduced into a plant cell or plant protoplast; such DNA or RNA can be introduced, e. g., by using a vector such as a plasmid or viral vector or as an mRNA, or as vector-less DNA or RNA introduced directly into a plant cell or plant protoplast.

In embodiments that further include the step of providing to a cell (e. g., a plant cell or plant protoplast) an RNA-guided nuclease or a polynucleotide that encodes the RNA-guided nuclease, the RNA-guided nuclease is provided simultaneously with the gRNA-containing composition, or in a separate step that precedes or follows the step of providing the gRNA-containing composition. In embodiments, the gRNA-containing composition further includes an RNA-guided nuclease or a polynucleotide that encodes the RNA-guided nuclease. In other embodiments, there is provided a separate composition that includes an RNA-guided nuclease or a polynucleotide that encodes the RNA-guided nuclease. In embodiments, the RNA-guided nuclease is provided as a ribonucleoprotein (RNP) complex, e. g., a preassembled RNP that includes the RNA-guided nuclease complexed with a polynucleotide including the gRNA or encoding a gRNA, or a preassembled RNP that includes a polynucleotide that encodes the RNA-guided nuclease (and optionally encodes the gRNA, or is provided with a separate polynucleotide including the gRNA or encoding a gRNA), complexed with a protein. In embodiments, the RNA-guided nuclease is a fusion protein, i. e., wherein the RNA-guided nuclease (e. g., Cas9, Cpf1, CasY, CasX, C2c1, or C2c3) is covalently bound through a peptide bond to a cell-penetrating peptide, a nuclear localization signal peptide, a chloroplast transit peptide, or a mitochondrial targeting peptide; such fusion proteins are conveniently encoded in a single nucleotide sequence, optionally including codons for linking amino acids. In embodiments, the RNA-guided nuclease or a polynucleotide that encodes the RNA-guided nuclease is provided as a complex with a cell-penetrating peptide or other transfecting agent. In embodiments, the RNA-guided nuclease or a polynucleotide that encodes the RNA-guided nuclease is complexed with, or covalently or non-covalently bound to, a further element, e. g., a carrier molecule, an antibody, an antigen, a viral movement protein, a polymer, a detectable label (e. g., a moiety detectable by fluorescence, radioactivity, or enzymatic or immunochemical reaction), a quantum dot, or a particulate or nanoparticulate. In embodiments, the RNA-guided nuclease or a polynucleotide that encodes the RNA-guided nuclease is provided in a solution, or is provided in a liposome, micelle, emulsion, reverse emulsion, suspension, or other mixed-phase composition.

An RNA-guided nuclease can be provided to a cell (e. g., a plant cell or plant protoplast) by any suitable technique. In embodiments, the RNA-guided nuclease is provided by directly contacting a plant cell or plant protoplast with the RNA-guided nuclease or the polynucleotide that encodes the RNA-guided nuclease. In embodiments, the RNA-guided nuclease is provided by transporting the RNA-guided nuclease or a polynucleotide that encodes the RNA-guided nuclease into a plant cell or plant protoplast using a chemical, enzymatic, or physical agent as provided in detail in the paragraphs following the heading "Delivery Methods and Delivery Agents". In embodiments, the RNA-guided nuclease is provided by bacterially mediated (e. g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection of a plant cell or plant protoplast with a polynucleotide encoding the RNA-guided nuclease; see, e. g., Broothaerts et al. (2005) *Nature,* 433:629-633. In an embodiment, the RNA-guided nuclease is provided by transcription in a plant cell or plant protoplast of a DNA that encodes the RNA-guided nuclease and is stably integrated in the genome of the plant cell or plant protoplast or that is provided to the plant cell or plant protoplast in the form of a plasmid or expression vector (e. g., a viral vector) that encodes the RNA-guided nuclease (and optionally encodes one or more gRNAs, crRNAs, or sgRNAs, or is optionally provided with a separate plasmid or vector that encodes one or more gRNAs, crRNAs, or sgRNAs). In embodiments, the RNA-guided nuclease is provided to the plant cell or plant protoplast as a polynucleotide that encodes the RNA-guided nuclease, e. g., in the form of an mRNA encoding the nuclease.

Where a polynucleotide is concerned (e. g., a crRNA that includes the gRNA together with a separate tracrRNA, or a crRNA and a tracrRNA encoded on a single polynucleotide or on separate polynucleotides, or at least one polynucleotide that is processed into one or more crRNAs and a tracrRNA, or a sgRNA that includes the gRNA, or a polynucleotide that encodes a sgRNA, or a polynucleotide that is processed into a sgRNA, or a polynucleotide that encodes the RNA-guided nuclease), embodiments of the polynucleotide include: (a) double-stranded RNA; (b) single-stranded RNA; (c) chemically modified RNA; (d) double-stranded DNA; (e) single-stranded DNA; (f) chemically modified DNA; or (g) a combination of (a)-(f). Where expression of a polynucleotide is involved (e. g., expression of a crRNA from a DNA encoding the crRNA, or expression and translation of a RNA-guided nuclease from a DNA encoding the nuclease), in some embodiments it is sufficient that expression be transient, i. e., not necessarily permanent or stable in the cell. Certain embodiments of the polynucleotide further include additional nucleotide sequences that provide useful functionality; non-limiting examples of such additional nucleotide sequences include an aptamer or riboswitch sequence, nucleotide sequence that provides secondary structure such as stem-loops or that provides a sequence-specific site for an enzyme (e. g., a sequence-specific recombinase or endonuclease site), T-DNA (e. g., DNA sequence encoding a gRNA, crRNA, tracrRNA, or sgRNA is enclosed between left and right T-DNA borders from *Agrobacterium* spp. or from other bacteria that infect or induce tumours in plants), a DNA nuclear-targeting sequence, a regulatory sequence such as a promoter sequence, and a transcript-stabilizing sequence. Certain embodiments of the polynucleotide include those wherein the polynucleotide is complexed with, or covalently or non-covalently bound to, a non-nucleic acid element, e. g., a carrier molecule, an antibody, an antigen, a viral movement protein, a cell-penetrating or pore-forming peptide, a polymer, a detectable label, a quantum dot, or a particulate or nanoparticulate.

In embodiments, the at least one DSB is introduced into the genome by at least one treatment selected from the group consisting of: (a) bacterially mediated (e. g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection with a DSB-inducing agent; (b) Biolistics or particle bombardment with a DSB-inducing agent; (c) treatment with at least one chemical, enzymatic, or physical agent as provided in detail in the paragraphs following the heading "Delivery Methods and Delivery Agents"; and (d) application of heat or cold, ultrasonication, centrifugation, positive or negative pressure, cell wall or membrane disruption or deformation, or electroporation. It is generally desirable that introduction of the at least one DSB into the genome (i. e., the "editing" of the genome) is achieved with sufficient efficiency and accuracy to ensure practical utility. One measure of efficiency is the percentage or fraction of the population of cells that have been treated with a DSB-inducing agent and in which the DSB is successfully introduced at the correct site in the genome. The efficiency of genome editing is assessed by any suitable method such as a heteroduplex cleavage assay or by sequencing, as described elsewhere in this disclosure. Accuracy is indicated by the absence of, or minimal occurrence of, off-target introduction of a DSB (i. e., at other than the intended site in the genome).

The location where the at least one DSB is inserted varies according to the desired result, for example whether the intention is to simply disrupt expression of the sequence of interest, or to add functionality (such as placing expression of the sequence of interest under inducible control). Thus, the location of the DSB is not necessarily within or directly adjacent to the sequence of interest. In embodiments, the at least one DSB in a genome is located: (a) within the sequence of interest, (b) upstream of (i. e., 5' to) the sequence of interest, or (c) downstream of (i. e., 3' to) the sequence of interest. In embodiments, a sequence encoded by the polynucleotide (such as a double-stranded DNA, a single-stranded DNA, a single-stranded DNA/RNA hybrid, or a double-stranded DNA/RNA hybrid) donor molecule, when integrated into the genome, is functionally or operably linked (e. g., linked in a manner that modifies the transcription or the translation of the sequence of interest or that modifies the stability of a transcript including that of the sequence of interest) to the sequence of interest. In embodiments, a sequence encoded by the polynucleotide donor molecule is integrated at a location 5' to and operably linked to the sequence of interest, wherein the integration location is selected to provide a specifically modulated (upregulated or downregulated) level of expression of the sequence of interest. For example, a sequence encoded by the polynucleotide donor molecule is integrated at a specific location in the promoter region of a protein-encoding gene that results in a desired expression level of the protein; in an embodiment, the appropriate location is determined empirically by integrating a sequence encoded by the polynucleotide donor molecule at about 50, about 100, about 150, about 200, about 250, about 300, about 350, about 400, about 450, and about 500 nucleotides 5' to (upstream of) the start codon of the coding sequence, and observing the relative expression levels of the protein for each integration location.

In embodiments, the donor polynucleotide sequence of interest includes coding (protein-coding) sequence, non-coding (non-protein-coding) sequence, or a combination of coding and non-coding sequence. Embodiments include a plant nuclear sequence, a plant plastid sequence, a plant mitochondrial sequence, a sequence of a symbiont, pest, or pathogen of a plant, and combinations thereof. Embodiments include exons, introns, regulatory sequences including promoters, other 5' elements and 3' elements, and genomic loci encoding non-coding RNAs including long non-coding RNAs (lncRNAs), microRNAs (miRNAs), and trans-acting siRNAs (ta-siRNAs). In embodiments, multiple sequences are altered, for example, by delivery of multiple gRNAs to the plant cell or plant protoplast; the multiple sequences can be part of the same gene (e. g., different locations in a single coding region or in different exons or introns of a protein-coding gene) or different genes. In embodiments, the sequence of an endogenous genomic locus is altered to delete, add, or modify a functional non-coding sequence; in non-limiting examples, such functional non-coding sequences include, e. g., a miRNA, siRNA, or ta-siRNA recognition or cleavage site, a splice site, a recombinase recognition site, a transcription factor binding site, or a transcriptional or translational enhancer or repressor sequence.

In embodiments, the invention provides a method of changing expression of a sequence of interest in a genome, including integrating a sequence encoded by a polynucleotide (such as a double-stranded DNA, a single-stranded DNA, a single-stranded DNA/RNA hybrid, or a double-stranded DNA/RNA hybrid) donor molecule at the site of two or more DSBs in a genome. In embodiments, the sequence of the polynucleotide donor molecule that is integrated into each of the two or more DSBs is (a) identical, or (b) different, for each of the DSBs. In embodiments, the change in expression of a sequence of interest in genome is manifested as the expression of an altered or edited sequence of interest; in non-limiting examples, the method is used to integrate sequence-specific recombinase recognition site sequences at two DSBs in a genome, whereby, in the presence of the corresponding site-specific DNA recombinase, the genomic sequence flanked on either side by the integrated recombinase recognition sites is excised from the genome (or in some instances is inverted); such an approach is useful, e. g., for deletion of larger lengths of genomic sequence, for example, deletion of all or part of an exon or of one or more protein domains. In other embodiments, at least two DSBs are introduced into a genome by one or more nucleases in such a way that genomic sequence is deleted between the DSBs (leaving a deletion with blunt ends, overhangs or a combination of a blunt end and an overhang), and a sequence encoded by at least one polynucleotide donor molecule is integrated between the DSBs (i. e., a sequence encoded by at least one individual polynucleotide donor molecule is integrated at the location of the deleted genomic sequence), wherein the genomic sequence that is deleted is coding sequence, non-coding sequence, or a combination of coding and non-coding sequence; such embodiments provide the advantage of not requiring a specific PAM site at or very near the location of a region wherein a nucleotide sequence change is desired. In an embodiment, at least two DSBs are introduced into a genome by one or more nucleases in such a way that genomic sequence is deleted between the DSBs (leaving a deletion with blunt ends, overhangs or a combination of a blunt end and an overhang), and at least one sequence encoded by a polynucleotide donor molecule is integrated between the DSBs (i. e., at least one individual sequence encoded by a polynucleotide donor molecule is integrated at the location of the deleted genomic sequence). In an embodiment, two DSBs are introduced into a genome, resulting in excision or deletion of genomic sequence between the sites of the two DSBs, and a sequence encoded by a polynucleotide donor molecule integrated into the genome at the location of the deleted genomic sequence (that is, a sequence encoded by an individual polynucleotide donor molecule is integrated between the two DSBs). Generally, the polynucleotide donor molecule with the sequence to be integrated into the genome is selected in terms of the presence or absence of terminal overhangs to match the type of DSBs introduced. In an embodiment, two blunt-ended DSBs are introduced into a genome, resulting in excision or deletion of genomic sequence between the sites of the two blunt-ended DSBs, and a sequence encoded by a blunt-ended double-stranded DNA or blunt-ended double-stranded DNA/RNA hybrid or a single-stranded DNA or a single-stranded DNA/RNA hybrid donor molecule is integrated into the genome between the two blunt-ended DSBs. In another embodiment, two DSBs are introduced into a genome, wherein the first DSB is blunt-ended and the second DSB has an overhang, resulting in deletion of genomic sequence between the two DSBs, and a sequence encoded by a double-stranded DNA or double-stranded DNA/RNA hybrid donor molecule that is blunt-ended at one terminus and that has an overhang on the other terminus (or, alternatively, a single-stranded DNA or a single-stranded DNA/RNA hybrid molecule) is integrated into the genome between the two DSBs; in an alternative embodiment, two DSBs are introduced into a genome, wherein both DSBs have overhangs but of different overhang lengths (different number of unpaired nucleotides), resulting in deletion of genomic sequence between the two DSBs, and a sequence encoded by a double-stranded DNA or double-stranded DNA/RNA hybrid donor molecule that has overhangs at each terminus, wherein the overhangs are of unequal lengths (or, alternatively, a single-stranded DNA or a single-stranded DNA/RNA hybrid donor molecule), is integrated into the genome between the two DSBs; embodiments with such DSB asymmetry (i. e., a combination of DSBs having a blunt end and an overhang, or a combination of DSBs having overhangs of unequal lengths) provide the opportunity for controlling directionality or orientation of the inserted polynucleotide, e. g., by selecting a double-stranded DNA or double-stranded DNA/RNA hybrid donor molecule having one blunt end and one terminus with unpaired nucleotides, such that the polynucleotide is integrated preferably in one orientations. In another embodiment, two DSBs, each having an overhang, are introduced into a genome, resulting in excision or deletion of genomic sequence between the sites of the two DSBs, and a sequence encoded by a double-stranded DNA or double-stranded DNA/RNA hybrid donor molecule that has an overhang at each terminus (or, alternatively, a single-stranded DNA or a single-stranded DNA/RNA hybrid donor molecule) is integrated into the genome between the two DSBs. The length of genomic sequence that is deleted between two DSBs and the length of a sequence encoded by the polynucleotide donor molecule that is integrated in place of the deleted genomic sequence can be, but need not be equal. In embodiments, the distance between any two DSBs (or the length of the genomic sequence that is to be deleted) is at least 10, at least 15, at least 20, at least 25, at least 30, at least 40, at least 50, at least 60, at least 70, at least 80, or at least 100 nucleotides; in other embodiments the distance between any two DSBs (or the length of the genomic sequence that is to be deleted) is at least 100, at least 150, at least 200, at least 300, at least 400, at least 500, at least 600, at least 750, or at least 1000 nucleotides. In embodiments where more than two DSBs are introduced into genomic sequence, it is possible to effect different deletions of genomic sequence (for example, where three DSBs are introduced, genomic sequence can be deleted between the first and second DSBs, between the first and third DSBs, and between the second and third DSBs). In some embodiments, a sequence encoded by more than one polynucleotide donor molecule (e. g., multiple copies of a sequence encoded by a polynucleotide donor molecule having a given sequence, or multiple sequences encoded by polynucleotide donor molecules with two or more different sequences) is integrated into the genome. For example, different sequences encoded by individual polynucleotide donor molecules can be individually integrated at a single locus where genomic sequence has been deleted between two DSBs, or at multiple locations where genomic sequence has been deleted (e. g., where more than two DSBs have been introduced into the genome). In embodiments, at least one exon is replaced by integrating a sequence encoded by at least one polynucleotide molecule where genomic sequence is deleted between DSBs that were introduced by at least one sequence-specific nuclease into intronic sequence flanking the at least one exon; an advantage of this approach over an otherwise similar method (i. e., differing by having the DSBs introduced into coding sequence instead of intronic sequence) is the avoidance of inaccuracies (nucleotide changes, deletions, or additions at the nuclease cleavage sites) in the resulting exon sequence or messenger RNA.

In embodiments, the methods described herein are used to delete or replace genomic sequence, which can be a relatively large sequence (e. g., all or part of at least one exon or of a protein domain) resulting in the equivalent of an alternatively spliced transcript. Additional related aspects include compositions and reaction mixtures including a plant cell or a plant protoplast and at least two guide RNAs, wherein each guide RNA is designed to effect a DSB in intronic sequence flanking at least one exon; such compositions and reaction mixtures optionally include at least one sequence-specific nuclease capable of being guided by at least one of the guide RNAs to effect a DSB in genomic sequence, and optionally include a polynucleotide donor molecule that is capable of being integrated (or having its sequence integrated) into the genome at the location of at least one DSB or at the location of genomic sequence that is deleted between the DSBs.

Donor Polynucleotide Molecules: Embodiments of the polynucleotide donor molecule having a sequence that is integrated at the site of at least one double-strand break (DSB) in a genome include double-stranded DNA, a single-stranded DNA, a single-stranded DNA/RNA hybrid, and a double-stranded DNA/RNA hybrid. In embodiments, a polynucleotide donor molecule that is a double-stranded (e. g., a dsDNA or dsDNA/RNA hybrid) molecule is provided directly to the plant protoplast or plant cell in the form of a double-stranded DNA or a double-stranded DNA/RNA hybrid, or as two single-stranded DNA (ssDNA) molecules that are capable of hybridizing to form dsDNA, or as a single-stranded DNA molecule and a single-stranded RNA (ssRNA) molecule that are capable of hybridizing to form a double-stranded DNA/RNA hybrid; that is to say, the double-stranded polynucleotide molecule is not provided indirectly, for example, by expression in the cell of a dsDNA encoded by a plasmid or other vector. In various non-limiting embodiments of the method, the polynucleotide donor molecule that is integrated (or that has a sequence that is integrated) at the site of at least one double-strand break (DSB) in a genome is double-stranded and blunt-ended; in other embodiments the polynucleotide donor molecule is double-stranded and has an overhang or "sticky end" consisting of unpaired nucleotides (e. g., 1, 2, 3, 4, 5, or 6 unpaired nucleotides) at one terminus or both termini. In an embodiment, the DSB in the genome has no unpaired nucleotides at the cleavage site, and the polynucleotide donor molecule that is integrated (or that has a sequence that is integrated) at the site of the DSB is a blunt-ended double-stranded DNA or blunt-ended double-stranded DNA/RNA hybrid molecule, or alternatively is a single-stranded DNA or a single-stranded DNA/RNA hybrid molecule. In another embodiment, the DSB in the genome has one or more unpaired nucleotides at one or both sides of the cleavage site, and the polynucleotide donor molecule that is integrated (or that has a sequence that is integrated) at the site of the DSB is a double-stranded DNA or double-stranded DNA/RNA hybrid molecule with an overhang or "sticky end" consisting of unpaired nucleotides at one or both termini, or alternatively is a single-stranded DNA or a single-stranded DNA/RNA hybrid molecule; in embodiments, the polynucleotide donor molecule DSB is a double-stranded DNA or double-stranded DNA/RNA hybrid molecule that includes an overhang at one or at both termini, wherein the overhang consists of the same number of unpaired nucleotides as the number of unpaired nucleotides created at the site of a DSB by a nuclease that cuts in an off-set fashion (e. g., where a Cpf1 nuclease effects an off-set DSB with 5-nucleotide overhangs in the genomic sequence, the polynucleotide donor molecule that is to be integrated (or that has a sequence that is to be integrated) at the site of the DSB is double-stranded and has 5 unpaired nucleotides at one or both termini) Generally, one or both termini of the polynucleotide donor molecule contain no regions of sequence homology (identity or complementarity) to genomic regions flanking the DSB; that is to say, one or both termini of the polynucleotide donor molecule contain no regions of sequence that is sufficiently complementary to permit hybridization to genomic regions immediately adjacent to the location of the DSB. In embodiments, the polynucleotide donor molecule contains no homology to the locus of the DSB, that is to say, the polynucleotide donor molecule contains no nucleotide sequence that is sufficiently complementary to permit hybridization to genomic regions immediately adjacent to the location of the DSB. In an embodiment, the polynucleotide donor molecule that is integrated at the site of at least one double-strand break (DSB) includes between 2-20 nucleotides in one (if single-stranded) or in both strands (if double-stranded), e. g., 2, 3, 4, 5, 6, 7, 8, 9, 10, 11, 12, 13, 14, 15, 16, 17, 18, 19, or 20 nucleotides on one or on both strands, each of which can be base-paired to a nucleotide on the opposite strand (in the case of a perfectly base-paired double-stranded polynucleotide molecule). In embodiments, the polynucleotide donor molecule is at least partially double-stranded and includes 2-20 base-pairs, e. g., 2, 3, 4, 5, 6, 7, 8, 9, 10, 11, 12, 13, 14, 15, 16, 17, 18, 19, or 20 base-pairs; in embodiments, the polynucleotide donor molecule is double-stranded and blunt-ended and consists of 2-20 base-pairs, e. g., 2, 3, 4, 5, 6, 7, 8, 9, 10, 11, 12, 13, 14, 15, 16, 17, 18, 19, or 20 base-pairs; in other embodiments, the polynucleotide donor molecule is double-stranded and includes 2-20 base-pairs, e. g., 2, 3, 4, 5, 6, 7, 8, 9, 10, 11, 12, 13, 14, 15, 16, 17, 18, 19, or 20 base-pairs and in addition has at least one overhang or "sticky end" consisting of at least one additional, unpaired nucleotide at one or at both termini Non-limiting examples of such relatively small polynucleotide donor molecules of 20 or fewer base-pairs (if double-stranded) or 20 or fewer nucleotides (if single-stranded) include polynucleotide donor molecules that have at least one strand including a transcription factor recognition site sequence (e. g., such as the sequences of transcription factor recognition sites provided in the working Examples), or that have at least one strand including a small RNA recognition site, or that have at least one strand including a recombinase recognition site. In an embodiment, the polynucleotide donor molecule that is integrated (or that has a sequence that is integrated) at the site of at least one double-strand break (DSB) in a genome is a blunt-ended double-stranded DNA or a blunt-ended double-stranded DNA/RNA hybrid molecule of about 18 to about 300 base-pairs, or about 20 to about 200 base-pairs, or about 30 to about 100 base-pairs, and having at least one phosphorothioate bond between adjacent nucleotides at a 5' end, 3' end, or both 5' and 3' ends. In embodiments, the polynucleotide donor molecule includes single strands of at least 11, at least 18, at least 20, at least 30, at least 40, at least 60, at least 80, at least 100, at least 120, at least 140, at least 160, at least 180, at least 200, at least 240, at about 280, or at least 320 nucleotides. In embodiments, the polynucleotide donor molecule has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded). In embodiments, the polynucleotide donor molecule includes chemically modified nucleotides (see, e. g., the various modifications of internucleotide linkages, bases, and sugars described in Verma and Eckstein (1998) Annu. Rev. Biochem., 67:99-134); in embodiments, the naturally occurring phosphodiester backbone of the polynucleotide donor molecule is partially or completely modified with phosphorothioate, phosphorodithioate, or methylphosphonate internucleotide linkage modifications, or the polynucleotide donor molecule includes modified nucleoside bases or modified sugars, or the polynucleotide donor molecule is labeled with a fluorescent moiety (e. g., fluorescein or rhodamine or a fluorescent nucleoside analogue) or other detectable label (e. g., biotin or an isotope). In an embodiment, the polynucleotide donor molecule is double-stranded and perfectly base-paired through all or most of its length, with the possible exception of any unpaired nucleotides at either terminus or both termini. In another embodiment, the polynucleotide donor molecule is double-stranded and includes one or more non-terminal mismatches or non-terminal unpaired nucleotides within the otherwise double-stranded duplex. In another embodiment, the polynucleotide donor molecule contains secondary structure that provides stability or acts as an aptamer. Other related embodiments include double-stranded DNA/RNA hybrid molecules, single-stranded DNA/RNA hybrid donor molecules, and single-stranded DNA donor molecules (including single-stranded, chemically modified DNA donor molecules), which in analogous procedures are integrated (or have a sequence that is integrated) at the site of a double-strand break.

In embodiments of the method, the polynucleotide (such as a double-stranded DNA, a single-stranded DNA, a single-stranded DNA/RNA hybrid, or a double-stranded DNA/RNA hybrid) donor molecule that is integrated at the site of at least one double-strand break (DSB) in a genome includes nucleotide sequence(s) on one or on both strands that provide a desired functionality when the polynucleotide is integrated into the genome. In various non-limiting embodiments of the method, the sequence encoded by a donor polynucleotide that is inserted at the site of at least one double-strand break (DSB) in a genome includes at least one sequence selected from the group consisting of:

(a) DNA encoding at least one stop codon, or at least one stop codon on each strand, or at least one stop codon within each reading frame on each strand;

(b) DNA encoding heterologous primer sequence (e. g., a sequence of about 18 to about 22 contiguous nucleotides, or of at least 18 contiguous nucleotides, that can be used to initiate DNA polymerase activity at the site of the DSB);

(c) DNA encoding a unique identifier sequence (e. g., a sequence that when inserted at the DSB creates a heterologous sequence that can be used to identify the presence of the insertion);

(d) DNA encoding a transcript-stabilizing sequence;

(e) DNA encoding a transcript-destabilizing sequence;

(f) a DNA aptamer or DNA encoding an RNA aptamer or amino acid aptamer; and (g) DNA that includes or encodes a sequence recognizable by a specific binding agent.

In an embodiment, the sequence encoded by the polynucleotide (such as a double-stranded DNA, a single-stranded DNA, a single-stranded DNA/RNA hybrid, or a double-stranded DNA/RNA hybrid) donor molecule that is integrated at the site of at least one double-strand break (DSB) in a genome includes DNA encoding at least one stop codon, or at least one stop codon on each strand, or at least one stop codon within each reading frame on each strand. Such sequence encoded by a polynucleotide donor molecule, when integrated at a DSB in a genome can be useful for disrupting the expression of a sequence of interest, such as a protein-coding gene. An example of such a polynucleotide donor molecule is a double-stranded DNA, a single-stranded DNA, a single-stranded DNA/RNA hybrid, or a double-stranded DNA/RNA hybrid donor molecule, of at least 18 contiguous base-pairs if double-stranded or at least 11 contiguous nucleotides if single-stranded, and encoding at least one stop codon in each possible reading frame on either strand. Another example of such a polynucleotide donor molecule is a double-stranded DNA or double-stranded DNA/RNA hybrid donor molecule wherein each strand includes at least 18 and fewer than 200 contiguous base-pairs, wherein the number of base-pairs is not divisible by 3, and wherein each strand encodes at least one stop codon in each possible reading frame in the 5' to 3' direction. Another example of such a polynucleotide donor molecule is a single-stranded DNA or single-stranded DNA/RNA hybrid donor molecule wherein each strand includes at least 11 and fewer than about 300 contiguous nucleotides, wherein the number of base-pairs is not divisible by 3, and wherein the polynucleotide donor molecule encodes at least one stop codon in each possible reading frame in the 5' to 3' direction.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA encoding heterologous primer sequence (e. g., a sequence of about 18 to about 22 contiguous nucleotides, or of at least 18, at least 20, or at least 22 contiguous nucleotides that can be used to initiate DNA polymerase activity at the site of the DSB). Heterologous primer sequence can further include nucleotides of the genomic sequence directly flanking the site of the DSB.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides encoding a unique identifier sequence (e. g., a sequence that when inserted at the DSB creates a heterologous sequence that can be used to identify the presence of the insertion)

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides encoding a transcript-stabilizing sequence. In an example, sequence of a double-stranded or single-stranded DNA or a DNA/RNA hybrid donor molecule encoding a 5' terminal RNA-stabilizing stem-loop (see, e. g., Suay (2005) *Nucleic Acids Rev.*, 33:4754-4761) is integrated at a DSB located 5' to the sequence for which improved transcript stability is desired. In another embodiment, the polynucleotide donor molecule that is integrated (or that has a sequence that is integrated) at the site of at least one double-strand break (DSB) in a genome includes nucleotides encoding a transcript-destabilizing sequence such as the SAUR destabilizing sequences described in detail in U.S. Patent Application Publication 2007/0011761, incorporated herein by reference.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes a DNA aptamer or DNA encoding an RNA aptamer or amino acid aptamer. Nucleic acid (DNA or RNA) aptamers are single- or double-stranded nucleotides that bind specifically to molecules or ligands which include small molecules (e. g., secondary metabolites such as alkaloids, terpenes, flavonoids, and other small molecules, as well as larger molecules such as polyketides and non-ribosomal proteins), proteins, other nucleic acid molecules, and inorganic compounds. Introducing an aptamer at a specific location in the genome is useful, e. g., for adding binding specificity to an enzyme or for placing expression of a transcript or activity of an encoded protein under ligand-specific control. In an example, the polynucleotide donor molecule encodes a poly-histidine "tag" which is integrated at a DSB downstream of a protein or protein subunit, enabling the protein expressed from the resulting transcript to be purified by affinity to nickel, e. g., on nickel resins; in an embodiments, the polynucleotide donor molecule encodes a 6×-His tag, a 10×-His tag, or a 10×-His tag including one or more stop codons following the histidine-encoding codons, where the last is particularly useful when integrated downstream of a protein or protein subunit lacking a stop codon (see, e. g., parts[dot]igem[dot]org/Part: BBa_K844000). In embodiments, the polynucleotide donor molecule encodes a riboswitch, wherein the riboswitch includes both an aptamer which changes its conformation in the presence or absence of a specific ligand, and an expression-controlling region that turns expression on or off, depending on the conformation of the aptamer. See, for example, the regulatory RNA molecules containing ligand-specific aptamers described in U.S. Patent Application Publication 2013/0102651 and the various riboswitches described in U.S. Patent Application Publication 2005/0053951, both of which publications are incorporated herein by reference.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides that include or encode a sequence recognizable by (i. e., binds to) a specific binding agent. Non-limiting embodiments of specific binding agents include nucleic acids, peptides or proteins, non-peptide/non-nucleic acid ligands, inorganic molecules, and combinations thereof; specific binding agents also include macromolecular assemblages such as lipid bilayers, cell components or organelles, and even intact cells or organisms. In embodiments, the specific binding agent is an aptamer or riboswitch, or alternatively is recognized by an aptamer or a riboswitch. In an embodiment, the invention provides a method of changing expression of a sequence of interest in a genome, comprising integrating a polynucleotide molecule at the site of a DSB in a genome, wherein the polynucleotide donor molecule includes a sequence recognizable by a specific binding agent, wherein the integrated sequence encoded by the polynucleotide donor molecule is functionally or operably linked to a sequence of interest, and wherein contacting the integrated sequence encoded by the polynucleotide donor molecule with the specific binding agent results in a change of expression of the sequence of interest; in embodiments, sequences encoded by different polynucleotide donor molecules are integrated at multiple DSBs in a genome.

In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes nucleotides that include or encode a sequence recognizable by (i. e., binds to) a specific binding agent, wherein:

(a) the sequence recognizable by a specific binding agent includes an auxin response element (AuxRE) sequence, the specific binding agent is an auxin, and the change of expression is upregulation; see, e. g., Walker and Estelle (1998) *Curr. Opinion Plant Biol.*, 1:434-439;

(b) the sequence recognizable by a specific binding agent includes at least one D1-4 sequence (CCTCGTGTCTC, SEQ ID NO:328; see Ulmasov et al. (1997) *Plant Cell,* 9:1963-1971), the specific binding agent is an auxin, and the change of expression is upregulation;

(c) the sequence recognizable by a specific binding agent includes at least one DR5 sequence (CCTTTTGTCTC, SEQ ID NO:329; see Ulmasov et al. (1997) Plant Cell, 9:1963-1971), the specific binding agent is an auxin, and the change of expression is upregulation;

(d) the sequence recognizable by a specific binding agent includes at least one m5-DR5 sequence (CCTTTTGTCNC, wherein N is A, C, or G, SEQ ID NO:330; see Ulmasov et al. (1997) *Plant Cell,* 9:1963-1971), the specific binding agent is an auxin, and the change of expression is upregulation;

(e) the sequence recognizable by a specific binding agent includes at least one P3 sequence (TGTCTC, SEQ ID NO:331), the specific binding agent is an auxin, and the change of expression is upregulation;

(f) the sequence recognizable by a specific binding agent includes a small RNA recognition site sequence, the specific binding agent is the corresponding small RNA (e. g., an siRNA, a microRNA (miRNA), a trans-acting siRNA as described in U.S. Pat. No. 8,030,473, or a phased sRNA as described in U.S. Pat. No. 8,404,928; both of these cited patents are incorporated by reference herein), and the change of expression is downregulation (non-limiting examples are given below, under the heading "Small RNAs");

(g) the sequence recognizable by a specific binding agent includes a microRNA (miRNA) recognition site sequence, the specific binding agent is the corresponding mature miRNA, and the change of expression is downregulation (non-limiting examples are given below, under the heading "Small RNAs");

(h) the sequence recognizable by a specific binding agent includes a microRNA (miRNA) recognition sequence for an engineered miRNA, the specific binding agent is the corresponding engineered mature miRNA, and the change of expression is downregulation;

(i) the sequence recognizable by a specific binding agent includes a transposon recognition sequence, the specific binding agent is the corresponding transposon, and the change of expression is upregulation or downregulation;

(j) the sequence recognizable by a specific binding agent includes an ethylene-responsive element binding-factor-associated amphiphilic repression (EAR) motif (LxLxL, SEQ ID NO:332 or DLNxxP, SEQ ID NO:333) sequence (see, e. g., Ragale and Rozwadowski (2011) *Epigenetics,* 6:141-146), the specific binding agent is ERF (ethylene-responsive element binding factor) or co-repressor (e. g., TOPLESS (TPL)), and the change of expression is downregulation;

(k) the sequence recognizable by a specific binding agent includes a splice site sequence (e. g., a donor site, a branching site, or an acceptor site; see, for example, the splice sites and splicing signals publicly available at the ERIS database, lemur[dot]amu[dot]edu[dot]pl/share/ERISdb/home.html), the specific binding agent is a spliceosome, and the change of expression is expression of an alternatively spliced transcript (in some cases, this can include deletion of a relatively large genomic sequence, such as deletion of all or part of an exon or of a protein domain);

(l) the sequence recognizable by a specific binding agent includes a recombinase recognition site sequence that is recognized by a site-specific recombinase, the specific binding agent is the corresponding site-specific recombinase, and the change of expression is upregulation or downregulation or expression of a transcript having an altered sequence (for example, expression of a transcript that has had a region of DNA excised by the recombinase) (non-limiting examples are given below, under the heading "Recombinases and Recombinase Recognition Sites");

(m) the sequence recognizable by a specific binding agent includes sequence encoding an RNA or amino acid aptamer or an RNA riboswitch, the specific binding agent is the corresponding ligand, and the change in expression is upregulation or downregulation;

(n) the sequence recognizable by a specific binding agent is a hormone responsive element (e. g., a nuclear receptor, or a hormone-binding domain thereof), the specific binding agent is a hormone, and the change in expression is upregulation or downregulation; or (o) the sequence recognizable by a specific binding agent is a transcription factor binding sequence, the specific binding agent is the corresponding transcription factor, and the change in expression is upregulation or downregulation (non-limiting examples are given below, under the heading "Transcription Factors").

In embodiments, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes a nucleotide sequence that encodes an RNA molecule or an amino acid sequence that is recognizable by a specific binding agent. In embodiments, the polynucleotide donor molecule includes a nucleotide sequence that binds specifically to a ligand or that encodes an RNA molecule or an amino acid sequence that binds specifically to a ligand. In embodiments, the polynucleotide donor molecule encodes at least one stop codon on each strand, or encodes at least one stop codon within each reading frame on each strand.

In embodiments, the polynucleotide (such as a double-stranded DNA, a single-stranded DNA, a single-stranded DNA/RNA hybrid, or a double-stranded DNA/RNA hybrid) donor molecule includes at least partially self-complementary sequence, such that the polynucleotide donor molecule encodes a transcript that is capable of forming at least partially double-stranded RNA. In embodiments, the at least partially double-stranded RNA is capable of forming secondary structure containing at least one stem-loop (i. e., a substantially or perfectly double-stranded RNA "stem" region and a single-stranded RNA "loop" connecting opposite strands of the dsRNA stem. In embodiments, the at least partially double-stranded RNA is cleavable by a Dicer or other ribonuclease. In embodiments, the at least partially double-stranded RNA includes an aptamer or a riboswitch; see, e. g., the RNA aptamers described in U.S. Patent Application Publication 2013/0102651, which is incorporated herein by reference.

In embodiments, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes or encodes a nucleotide sequence that is responsive to a specific change in the physical environment (e. g., a change in light intensity or quality, a change in temperature, a change in pressure, a change in osmotic concentration, a change in day length, or addition or removal of a ligand or specific binding agent), wherein exposing the integrated polynucleotide sequence to the specific change in the physical environment results in a change of expression of the sequence of interest. In embodiments, the polynucleotide donor molecule includes a nucleotide sequence encoding an RNA molecule or an amino acid sequence that is responsive to a specific change in the physical environment. In a non-limiting example, the polynucleotide donor molecule encodes an amino acid sequence that is responsive to light, oxygen, redox status, or voltage, such as a Light-Oxygen-Voltage (LOV) domain (see, e. g., Peter et al. (2010) *Nature Communications, doi:*10.1038/ncomms1121) or a PAS domain (see, e. g., Taylor and Zhulin (1999) *Microbiol. Mol. Biol. Reviews,* 63:479-506), proteins containing such domains, or sub-domains or motifs thereof (see, e. g., the photochemically active 36-residue N-terminal truncation of the VVD protein described by Zoltowski et al. (2007) *Science,* 316:1054-1057). In a non-limiting embodiment, integration of a LOV domain at the site of a DSB within or adjacent to a protein-coding region is used to create a heterologous fusion protein that can be photoactivated.

Small RNAs: In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA that includes or encodes a small RNA recognition site sequence that is recognized by a corresponding mature small RNA. Small RNAs include siRNAs, microRNAs (miRNAs), trans-acting siRNAs (ta-siRNAs) as described in U.S. Pat. No. 8,030,473, and phased small RNAs (phased sRNAs) as described in U.S. Pat. No. 8,404,928. All mature small RNAs are single-stranded RNA molecules, generally between about 18 to about 26 nucleotides in length, which are produced from longer, completely or substantially double-stranded RNA (dsRNA) precursors. For example, siRNAs are generally processed from perfectly or near-perfectly double-stranded RNA precursors, whereas both miRNAs and phased sRNAs are processed from larger precursors that contain at least some mismatched (non-base-paired) nucleotides and often substantial secondary structure such as loops and bulges in the otherwise largely double-stranded RNA precursor. Precursor molecules include naturally occurring precursors, which are often expressed in a specific (e. g., cell- or tissue-specific, temporally specific, developmentally specific, or inducible) expression pattern. Precursor molecules also include engineered precursor molecules, designed to produce small RNAs (e. g., artificial or engineered siRNAs or miRNAs) that target specific sequences; see, e. g., U.S. Pat. Nos. 7,691,995 and 7,786,350, which are incorporated herein by reference in their entirety. Thus, in embodiments, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA that includes or encodes a small RNA precursor sequence designed to be processed in vivo to at least one corresponding mature small RNA. In embodiments, the polynucleotide donor molecule that is integrated (or that has a sequence that is integrated) at the site of at least one double-strand break (DSB) in a genome includes DNA that includes or encodes an engineered small RNA precursor sequence that is based on a naturally occurring "scaffold" precursor sequence but wherein the nucleotides of the encoded mature small RNA are designed to target a specific gene of interest that is different from the gene targeted by the natively encoded small RNA; in embodiments, the "scaffold" precursor sequence is one identified from the genome of a plant or a pest or pathogen of a plant; see, e. g., U.S. Pat. No. 8,410,334, which discloses transgenic expression of engineered invertebrate miRNA precursors in a plant, and which is incorporated herein by reference in its entirety.

Regardless of the pathway that generates the mature small RNA, the mechanism of action is generally similar; the mature small RNA binds in a sequence-specific manner to a small RNA recognition site located on an RNA molecule (such as a transcript or messenger RNA), and the resulting duplex is cleaved by a ribonuclease. The integration of a recognition site for a small RNA at the site of a DSB results in cleavage of the transcript including the integrated recognition site when and where the mature small RNA is expressed and available to bind to the recognition site. For example, a recognition site sequence for a mature siRNA or miRNA that is endogenously expressed only in male reproductive tissue of a plant can be integrated into a DSB, whereby a transcript containing the recognition site sequence is cleaved only where the mature siRNA or miRNA is expressed (i. e., in male reproductive tissue); this is useful, e. g., to prevent expression of a protein in male reproductive tissue such as pollen, and can be used in applications such as to induce male sterility in a plant or to prevent pollen development or shedding. Similarly, a recognition site sequence for a mature siRNA or miRNA that is endogenously expressed only in the roots of a plant can be integrated into a DSB, whereby a transcript containing the recognition site sequence is cleaved only in roots; this is useful, e. g., to prevent expression of a protein in roots. Non-limiting examples of useful small RNAs include: miRNAs having tissue-specific expression patterns disclosed in U.S. Pat. No. 8,334,430, miRNAs having temporally specific expression patterns disclosed in U.S. Pat. No. 8,314,290, miRNAs with stress-responsive expression patterns disclosed in U.S. Pat. No. 8,237,017, siRNAs having tissue-specific expression patterns disclosed in U.S. Pat. No. 9,139,838, and various miRNA recognition site sequences and the corresponding miRNAs disclosed in U.S. Patent Application Publication 2009/0293148. All of the patent publications referenced in this paragraph are incorporated herein by reference in their entirety. In embodiments, multiple edits in a genome are employed to obtain a desired phenotype or trait in plant. In an embodiment, one or more edits (addition, deletion, or substitution of one or more nucleotides) of an endogenous nucleotide sequence is made to provide a general phenotype; addition of at least one small RNA recognition site by insertion of the recognition site sequence at a DSB that is functionally linked to the edited endogenous nucleotide sequence achieves more specific control of expression of the edited endogenous nucleotide sequence. In an example, an endogenous plant 5-enolpyruvylshikimate-3-phosphate synthase (EPSPS) is edited to provide a glyphosate-resistant EPSPS; for example, suitable changes include the amino acid substitutions Threonine-102-Isoleucine (T102I) and Proline-106-Serine (P106S) in the maize EPSPS sequence identified by Genbank accession number X63374 (see, for example U.S. Pat. No. 6,762,344, incorporated herein by reference). In another example, an endogenous plant acetolactate synthase (ALS) is edited to increase resistance of the enzyme to various herbicides (e. g., sulfonylurea, imidazolinone, tirazolopyrimidine, pyrimidinylthiobenzoate, sulfonylamino-carbonyltriazolinone); for example, suitable changes include the amino acid substitutions G115, A116, P191, A199, K250, M345, D370, V565, W568, and F572 to the *Nicotiana tabacum* ALS enzyme as described in U.S. Pat. No. 5,605,011, which is incorporated herein by reference. The edited herbicide-tolerant enzyme, combined with integration of at least one small RNA recognition site for a small RNA (e. g., an siRNA or a miRNA) expressed only in a specific tissue (for example, miRNAs specifically expressed in male reproductive tissue or female reproductive tissue, e. g., the miRNAs disclosed in Table 6 of U.S. Pat. No. 8,334,430 or the siRNAs disclosed in U.S. Pat. No. 9,139,838, both incorporated herein by reference) at a DSB functionally linked to (e. g., in the 3' untranslated region of) the edited herbicide-tolerant enzyme results in expression of the edited herbicide-tolerant enzyme being restricted to tissues other than those in which the small RNA is endogenously expressed, and those tissues in which the small RNA is expressed will not be resistant to herbicide application; this approach is useful, e. g., to provide male-sterile or female-sterile plants.

In other embodiments, the sequence of an endogenous genomic locus encoding one or more small RNAs (e. g., miRNAs, siRNAs, ta-siRNAs) is altered in order to express a small RNA having a sequence that is different from that of the endogenous small RNA and is designed to target a new sequence of interest (e. g., a sequence of a plant pest, plant pathogen, symbiont of a plant, or symbiont of a plant pest or pathogen). For example, the sequence of an endogenous or native genomic locus encoding a miRNA precursor can be altered in the mature miRNA and the miR* sequences, while maintaining the secondary structure in the resulting altered miRNA precursor sequence to permit normal processing of the transcript to a mature miRNA with a different sequence from the original, native mature miRNA sequence; see, for example, U.S. Pat. Nos. 7,786,350 and 8,395,023, both of which are incorporated by reference in their entirety herein, and which teach methods of designing engineered miRNAs. In embodiments, the sequence of an endogenous genomic locus encoding one or more small RNAs (e. g., miRNAs, siRNAs, ta-siRNAs) is altered in order to express one or more small RNA cleavage blockers (see, e. g., U.S. Pat. No. 9,040,774, which is incorporated by reference in its entirety herein). In embodiments, the sequence of an endogenous genomic locus is altered to encode a small RNA decoy (e. g., U.S. Pat. No. 8,946,511, which is incorporated by reference in its entirety herein). In embodiments, the sequence of an endogenous genomic locus that natively contains a small RNA (e. g., miRNA, siRNA, or ta-siRNA) recognition or cleavage site is altered to delete or otherwise mutate the recognition or cleavage site and thus decouple the genomic locus from small RNA regulation.

Recombinases and Recombinase Recognition Sites: In an embodiment, the polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes DNA that includes or encodes a recombinase recognition site sequence that is recognized by a site-specific recombinase, the specific binding agent is the corresponding site-specific recombinase, and the change of expression is upregulation or downregulation or expression of a transcript having an altered sequence (for example, expression of a transcript that has had a region of DNA excised by the recombinase). The term "recombinase recognition site sequence" refers to the DNA sequences (usually a pair of sequences) that are recognized by a site-specific (i. e., sequence-specific) recombinase in a process that allows the excision (or, in some cases, inversion or translocation) of the DNA located between the sequence-specific recombination sites. For instance, Cre recombinase recognizes either loxP recombination sites or lox511 recombination sites which are heterospecific, which means that loxP and lox511 do not recombine together (see, e. g., Odell et al. (1994) *Plant Physiol.*, 106:447-458); FLP recombinase recognizes frt recombination sites (see, e. g., Lyznik et al. (1996) *Nucleic Acids Res.*, 24:3784-3789); R recombinase recognizes Rs recombination sites (see, e. g., Onounchi et al. (1991) *Nucleic Acids Res.*, 19:6373-6378); Dre recombinase recognizes rox sites (see, e. g., U.S. Pat. No. 7,422,889, incorporated herein by reference); and Gin recombinase recognizes gix sites (see, e. g., Maeser et al. (1991) *Mol. Gen. Genet.*, 230:170-176). In a non-limiting example, a pair of polynucleotides encoding loxP recombinase recognition site sequences encoded by a pair of polynucleotide donor molecules are integrated at two separate DSBs; in the presence of the corresponding site-specific DNA recombinase Cre, the genomic sequence flanked on either side by the integrated loxP recognition sites is excised from the genome (for loxP sequences that are integrated in the same orientation relative to each other within the genome) or is inverted (for loxP sites that are integrated in an inverted orientation relative to each other within the genome) or is translocated (for loxP sites that are integrated on separate DNA molecules); such an approach is useful, e. g., for deletion or replacement of larger lengths of genomic sequence, for example, deletion or replacement of one or more protein domains. In embodiments, the recombinase recognition site sequences that are integrated at two separate DSBs are heterospecific, i. e., will not recombine together; for example, Cre recombinase recognizes either loxP recombination sites or lox511 recombination sites which are heterospecific relative to each other, which means that a loxP site and a lox511 site will not recombine together but only with another recombination site of its own type.

Integration of recombinase recognition sites is useful in plant breeding; in an embodiment, the method is used to provide a first parent plant having recombinase recognition site sequences heterologously integrated at two separate DSBs; crossing this first parent plant to a second parent plant that expresses the corresponding recombinase results in progeny plants in which the genomic sequence flanked on either side by the heterologously integrated recognition sites is excised from (or in some cases, inverted in) the genome. This approach is useful, e. g., for deletion of relatively large regions of DNA from a genome, for example, for excising DNA encoding a selectable or screenable marker that was introduced using transgenic techniques. Examples of heterologous arrangements or integration patterns of recombinase recognition sites and methods for their use, particularly in plant breeding, are disclosed in U.S. Pat. No. 8,816,153 (see, for example, the Figures and working examples), the entire specification of which is incorporated herein by reference.

Transcription Factors: In an embodiment, the sequence encoded by the donor polynucleotide (such as a double-stranded DNA, a single-stranded DNA, a single-stranded DNA/RNA hybrid, or a double-stranded DNA/RNA hybrid) donor molecule that is integrated (or that has a sequence that is integrated) at the site of at least one double-strand break (DSB) in a genome includes a transcription factor binding sequence, the specific binding agent is the corresponding transcription factor (or more specifically, the DNA-binding domain of the corresponding transcription factor), and the change in expression is upregulation or downregulation (depending on the type of transcription factor involved). In an embodiment, the transcription factor is an activating transcription factor or activator, and the change in expression is upregulation or increased expression increased expression (e.g., increased expression of at least 10%, 15%, 20%, 25%, 30%, 35%, 40%, 50%, 60%, 70%, 80%, 90%, 95%, 100% or greater, e.g., at least a 2-fold, 5-fold, 10-fold, 20-fold, 30-fold, 40-fold, 50-fold change, 100-fold or even 1000-fold change or greater) of a sequence of interest to which the transcription factor binding sequence, when integrated at a DSB in the genome, is operably linked. In some embodiments, expression is increased between 10-100%; between 2-fold and 5-fold; between 2 and 10-fold; between 10-fold and 50-fold; between 10-fold and a 100-fold; between 100-fold and 1000-fold; between 1000-fold and 5,000-fold; between 5,000-fold and 10,000 fold. In some embodiments, a targeted insertion may decrease expression by at least 1%, 5%, 10%, 15%, 20%, 25%, 30%, 35%, 40%, 50%, 60%, 70%, 80%, 90%, 95%, 99% or more. In another embodiment, the transcription factor is a repressing transcription factor or repressor, and the change in expression is downregulation or decreased expression (e.g., decreased expression by at least 1%, 5%, 10%, 15%, 20%, 25%, 30%, 35%, 40%, 50%, 60%, 70%, 80%, 90%, 95%, 99% or more) of a sequence of interest to which the transcription factor binding sequence when integrated at a DSB in the genome, is operably linked. Embodiments of transcription factors include hormone receptors, e. g., nuclear receptors, which include both a hormone-binding domain and a DNA-binding domain; in embodiments, the polynucleotide donor molecule that is integrated (or that has a sequence that is integrated) at the site of at least one double-strand break (DSB) in a genome includes or encodes a hormone-binding domain of a nuclear receptor or a DNA-binding domain of a nuclear receptor. Various non-limiting examples of transcription factor binding sequences and transcription factors are provided in the working Examples. In embodiments, the sequence recognizable by a specific binding agent is a transcription factor binding sequence selected from those publicly disclosed at *Arabidopsis*[dot]med[dot]ohio-state[dot]edu/AtcisDB/bindingsites[dot]html and neomorph[dot]salk[dot]edu/dap_web/pages/index[dot]php.

To summarize, the methods described herein permit sequences encoded by donor polynucleotides to be inserted, in a non-multiplexed or multiplexed manner, into a plant cell genome for the purpose of modulating gene expression in a number of distinct ways. Gene expression can be modulated up or down, for example, by tuning expression through the insertion of enhancer elements and transcription start sequences (e.g., nitrate response elements and auxin binding elements). Conditional transcription factor binding sites can be added or modified to allow additional control. Similarly, transcript stabilizing and/or destabilizing sequences can be inserted using the methods herein. Via the targeted insertion of stop codons, RNAi cleavage sites, or sites for recombinases, the methods described herein allow the transcription of particular sequences to be selectively turned off (likewise, the targeted removal of such sequences can be used to turn gene transcription on).

The plant genome targeting methods disclosed herein also enable transcription rates to be adjusted by the modification (optimization or de-optimization) of core promoter sequences (e.g., TATAA boxes). Proximal control elements (e.g., GC boxes; CAAT boxes) can likewise be modified. Enhancer or repressor motifs can be inserted or modified. Three-dimensional structural barriers in DNA that inhibit RNA polymerase can be created or removed via the targeted insertion of sequences, or by the modification of existing sequences. Where intron mediated enhancement is known to affect transcript rate, the relevant rate-affecting sequences can be optimized or de-optimized (by insertion of additional sequences or modification of existing sequences) to further enhance or diminish transcription. Through the insertion or modification of sequences using the targeting methods described herein (including multiplexed targeting methods), mRNA stability and processing can be modulated (thereby modulating gene expression). For example, mRNA stabilizing or destabilizing motifs can be inserted, removed or modified; mRNA splicing donor/acceptor sites can be inserted, removed or modified and, in some instance, create the possibility of increased control over alternate splicing. Similarly, miRNA binding sites can be added, removed or modified using the methods described herein. Epigenetic regulation of transcription can also be adjusted according to the methods described herein (e.g., by increasing or decreasing the degree of methylation of DNA, or the degree of methylation or acetylation of histones). Epigenetic regulation using the tools and methods described herein can be combined with other methods for modifying genetic sequences described herein, for the purpose of modifying a trait of a plant cell or plant, or for creating populations of modified cells and cells from which desired phenotypes can be selected.

The plant genome targeting methods described herein can also be used to modulate translation efficiency by, e.g., modifying codon usage towards or away from a particular plant cell's bias. Similarly, through the use of the targeting methods described herein, KOZAK sequences can be optimized or deoptimized, mRNA folding and structures affecting initiation of translation can be altered, and upstream reading frames can be created or destroyed. Through alteration of coding sequences using the targeted genome modification methods described herein, the abundance and/or activity of translated proteins can be adjusted. For example, the amino acid sequences in active sites or functional sites of proteins can be modified to increase or decrease the activity of the protein as desired; in addition, or alternatively, protein stabilizing or destabilizing motifs can be added or modified. All of the gene expression and activity modification schemes described herein can be utilized in various combinations to fine-tune gene expression and activity. Using the multiplexed targeting methods described herein, a plurality of specific targeted modifications can be achieved in a plant cell without intervening selection or sequencing steps.

Modified Plant Cells Comprising Specifically Targeted and Modified Genomes

Another aspect of the invention includes the cell, such as a plant cell, provided by the methods disclosed herein. In an embodiment, a plant cell thus provided includes in its genome a heterologous DNA sequence that includes: (a) nucleotide sequence of a polynucleotide (such as a double-stranded DNA, a single-stranded DNA, a single-stranded DNA/RNA hybrid, or a double-stranded DNA/RNA hybrid) molecule integrated at the site of a DSB in a genome; and (b) genomic nucleotide sequence adjacent to the site of the DSB. In embodiments, the methods disclosed herein for integrating a sequence encoded by a polynucleotide donor molecule into the site of a DSB are applied to a plant cell (e. g., a plant cell or plant protoplast isolated from a whole plant or plant part or plant tissue, or an isolated plant cell or plant protoplast in suspension or plate culture); in other embodiments, the methods are applied to non-isolated plant cells in situ or in planta, such as a plant cell located in an intact or growing plant or in a plant part or tissue. The methods disclosed herein for integrating a sequence encoded by a polynucleotide donor molecule into the site of a DSB are also useful in introducing heterologous sequence at the site of a DSB induced in the genome of other photosynthetic eukaryotes (e. g., green algae, red algae, diatoms, brown algae, and dinoflagellates). In embodiments, the plant cell or plant protoplast is capable of division and further differentiation. In embodiments, the plant cell or plant protoplast is obtained or isolated from a plant or part of a plant selected from the group consisting of a plant tissue, a whole plant, an intact nodal bud, a shoot apex or shoot apical meristem, a root apex or root apical meristem, lateral meristem, intercalary meristem, a seedling (e. g., a germinating seed or small seedling or a larger seedling with one or more true leaves), a whole seed (e. g., an intact seed, or a seed with part or all of its seed coat removed or treated to make permeable), a halved seed or other seed fragment, a zygotic or somatic embryo (e. g., a mature dissected zygotic embryo, a developing zygotic or somatic embryo, a dry or rehydrated or freshly excised zygotic embryo), pollen, microspores, epidermis, flower, and callus.

In some embodiments, the method includes the additional step of growing or regenerating a plant from a plant cell containing the heterologous DNA sequence of the polynucleotide donor molecule integrated at the site of a DSB and genomic nucleotide sequence adjacent to the site of the DSB, wherein the plant includes at least some cells that contain the heterologous DNA sequence of the polynucleotide donor molecule integrated at the site of a DSB and genomic nucleotide sequence adjacent to the site of the DSB. In embodiments, callus is produced from the plant cell, and plantlets and plants produced from such callus. In other embodiments, whole seedlings or plants are grown directly from the plant cell without a callus stage. Thus, additional related aspects are directed to whole seedlings and plants grown or regenerated from the plant cell or plant protoplast containing sequence encoded by a polynucleotide (such as a double-stranded DNA, a single-stranded DNA, a single-stranded DNA/RNA hybrid, or a double-stranded DNA/RNA hybrid) donor molecule heterologously integrated at the site of a DSB, as well as the seeds of such plants; embodiments include whole seedlings and plants grown or regenerated from the plant cell or plant protoplast containing sequence encoded by a polynucleotide donor molecule heterologously integrated at the site of two or more DSBs, as well as the seeds of such plants. In embodiments, the grown or regenerated plant exhibits a phenotype associated with the sequence encoded by a polynucleotide donor molecule heterologously integrated at the site of a DSB. In embodiments, the grown or regenerated plant includes in its genome two or more genetic modifications that in combination provide at least one phenotype of interest, wherein at least one of the two or more genetic modifications includes the sequence encoded by a polynucleotide donor molecule heterologously integrated at the site of a DSB in the genome, or wherein the two or more genetic modifications include sequence encoded by at least one polynucleotide donor heterologously integrated at two or more DSBs in the genome, or wherein the two or more genetic modifications include sequences encoded by multiple polynucleotides donor molecules heterologously integrated at different DSBs in the genome. In embodiments, a heterogeneous population of plant cells or plant protoplasts, at least some of which include sequence encoded by at least one polynucleotide donor molecule heterologously integrated at the site of a DSB, is provided by the method; related aspects include a plant having a phenotype of interest associated with sequence encoded by the polynucleotide donor molecule heterologously integrated at the site of a DSB, provided by either regeneration of a plant having the phenotype of interest from a plant cell or plant protoplast selected from the heterogeneous population of plant cells or plant protoplasts, or by selection of a plant having the phenotype of interest from a heterogeneous population of plants grown or regenerated from the population of plant cells or plant protoplasts. Examples of phenotypes of interest include (but are not limited to) herbicide resistance; improved tolerance of abiotic stress (e. g., tolerance of temperature extremes, drought, or salt) or biotic stress (e. g., resistance to bacterial or fungal pathogens); improved utilization of nutrients or water; synthesis of new or modified amounts of lipids, carbohydrates, proteins or other chemicals, including medicinal compounds; improved flavour or appearance; improved photosynthesis; improved storage characteristics (e. g., resistance to bruising, browning, or softening); increased yield; altered morphology (e. g., floral architecture or colour, plant height, branching, root structure); and changes in flowering time. In an embodiment, a heterogeneous population of plant cells or plant protoplasts (or seedlings or plants grown or regenerated therefrom) is exposed to conditions permitting expression of the phenotype of interest; e. g., selection for herbicide resistance can include exposing the population of plant cells or plant protoplasts (or seedlings or plants) to an amount of herbicide or other substance that inhibits growth or is toxic, allowing identification and selection of those resistant plant cells or plant protoplasts (or seedlings or plants) that survive treatment. In certain embodiments, a proxy measurement can be taken of an aspect of a modified plant or plant cell, where the measurement is indicative of a desired phenotype or trait. For example, the modification of one or more targeted sequences in a genome may provide a measurable change in a molecule (e.g., a detectable change in the structure of a molecule, or a change in the amount of the molecule that is detected, or the presence or absence of a molecule) that can be used as a biomarker for a presence of a desired phenotype or trait. The proper insertion of an enhancer for increasing expression of an enzyme, for example, may be determined by detecting lower levels of the enyzme's substrate.

In some embodiments, modified plants are produced from cells modified according to the methods described herein without a tissue culturing step. In certain embodiments, the modified plant cell or plant does not have significant losses of methylation compared to a non-modified parent plant cell or plant. For example, the modified plant lacks significant losses of methylation in one or more promoter regions relative to the parent plant cell or plant. Similarly, in certain embodiments, an modified plant or plant cell obtained using the methods described herein lacks significant losses of methylation in protein coding regions relative to the parent cell or parent plant before modification using the modifying methods described herein.

Also contemplated are new heterogeneous populations, arrays, or libraries of plant cells and plants created by the introduction of targeted modifications at one more locations in the genome. Plant compositions of the invention include succeeding generations or seeds of modified plants that are grown or regenerated from plant cells or plant protoplasts modified according to the methods herein, as well as parts of those plants (including plant parts used in grafting as scions or rootstocks), or products (e. g., fruits or other edible plant parts, cleaned grains or seeds, edible oils, flours or starches, proteins, and other processed products) made from these plants or their seeds. Embodiments include plants grown or regenerated from the plant cells or plant protoplasts, wherein the plants contain cells or tissues that do not have sequence encoded by the polynucleotide donor molecule heterologously integrated at the site of a DSB, e. g., grafted plants in which the scion or rootstock contains sequence encoded by the polynucleotide donor molecule heterologously integrated at the site of a DSB, or chimeric plants in which some but not all cells or tissues contain sequence encoded by the polynucleotide donor molecule heterologously integrated at the site of a DSB. Plants in which grafting is commonly useful include many fruit trees and plants such as many citrus trees, apples, stone fruit (e. g., peaches, apricots, cherries, and plums), avocados, tomatoes, eggplant, cucumber, melons, watermelons, and grapes as well as various ornamental plants such as roses. Grafted plants can be grafts between the same or different (generally related) species. Additional related aspects include (a) a hybrid plant provided by crossing a first plant grown or regenerated from a plant cell or plant protoplast with sequence encoded by at least one polynucleotide donor molecule heterologously integrated at the site of a DSB, with a second plant, wherein the hybrid plant contains sequence encoded by the polynucleotide donor molecule heterologously integrated at the site of a DSB, and (b) a hybrid plant provided by crossing a first plant grown or regenerated from a plant cell or plant protoplast with sequence encoded by at least one polynucleotide donor molecule heterologously integrated at multiple DSB sites, with a second plant, wherein the hybrid plant contains sequence encoded by at least one polynucleotide donor molecule heterologously integrated at the site of at least one DSB; also contemplated is seed produced by the hybrid plant. Also envisioned as related aspects are progeny seed and progeny plants, including hybrid seed and hybrid plants, having the regenerated plant as a parent or ancestor. In embodiments, the plant cell (or the regenerated plant, progeny seed, and progeny plant) is diploid or polyploid. In embodiments, the plant cell (or the regenerated plant, progeny seed, and progeny plant) is haploid or can be induced to become haploid; techniques for making and using haploid plants and plant cells are known in the art, see, e. g., methods for generating haploids in *Arabidopsis thaliana* by crossing of a wild-type strain to a haploid-inducing strain that expresses altered forms of the centromere-specific histone CENH3, as described by Maruthachalam and Chan in "How to make haploid *Arabidopsis thaliana*", a protocol publicly available at www[dot]openwetware[dot]org/images/d/d3/Haploid_*Arabidopsis*_protocol[dot]pdf; Ravi et al. (2014) *Nature Communications,* 5:5334, doi: 10.1038/ncomms6334). Examples of haploid cells include but are not limited to plant cells obtained from haploid plants and plant cells obtained from reproductive tissues, e. g., from flowers, developing flowers or flower buds, ovaries, ovules, megaspores, anthers, pollen, and microspores. In embodiments where the plant cell is haploid, the method can further include the step of chromosome doubling (e. g., by spontaneous chromosomal doubling by meiotic non-reduction, or by using a chromosome doubling agent such as colchicine, oryzalin, trifluralin, pronamide, nitrous oxide gas, anti-microtubule herbicides, anti-microtubule agents, and mitotic inhibitors) in the plant cell containing heterologous DNA sequence (i. e. sequence of the polynucleotide donor molecule integrated at the site of a DSB in the genome and genomic nucleotide sequence adjacent to the site of the DSB) to produce a doubled haploid plant cell or plant protoplast that is homozygous for the heterologous DNA sequence; yet other embodiments include regeneration of a doubled haploid plant from the doubled haploid plant cell or plant protoplast, wherein the regenerated doubled haploid plant is homozygous for the heterologous DNA sequence.

Thus, aspects of the invention are related to the haploid plant cell or plant protoplast having the heterologous DNA sequence of the polynucleotide donor molecule integrated at the site of a DSB and genomic nucleotide sequence adjacent to the site of the DSB, as well as a doubled haploid plant cell or plant protoplast or a doubled haploid plant that is homozygous for the heterologous DNA sequence. Another aspect of the invention is related to a hybrid plant having at least one parent plant that is a doubled haploid plant provided by the method. Production of doubled haploid plants by these methods provides homozygosity in one generation, instead of requiring several generations of self-crossing to obtain homozygous plants; this may be particularly advantageous in slow-growing plants, such as fruit and other trees, or for producing hybrid plants that are offspring of at least one doubled-haploid plant.

Plants and plant cells that may be modified according to the methods described herein are of any species of interest, including dicots and monocots, but especially *Zea* species (including hybrid species).

The *Zea* sp. cells and derivative plants and seeds disclosed herein can be used for various purposes useful to the consumer or grower. The intact plant itself may be desirable, e. g., plants grown as cover crops or as ornamentals. In other embodiments, processed products are made from the plant or its seeds, such as extracted proteins, oils, sugars, and starches, fermentation products, animal feed or human food, wood and wood products, pharmaceuticals, and various industrial products. Thus, further related aspects of the invention include a processed or commodity product made from a plant or seed or plant part that includes at least some cells that contain the heterologous DNA sequence including the sequence encoded by the polynucleotide donor molecule integrated at the site of a DSB and genomic nucleotide sequence adjacent to the site of the DSB. Commodity products include, but are not limited to, harvested leaves, roots, shoots, tubers, stems, fruits, seeds, or other parts of a plant, meals, oils (edible or inedible), fiber, extracts, fermentation or digestion products, crushed or whole grains or seeds of a plant, wood and wood pulp, or any food or non-food product. Detection of a heterologous DNA sequence that includes: (a) nucleotide sequence encoded by a polynucleotide donor molecule integrated at the site of a DSB in a genome; and (b) genomic nucleotide sequence adjacent to the site of the DSB in such a commodity product is de facto evidence that the commodity product contains or is derived from a plant cell, plant, or seed of this invention.

In another aspect, the invention provides a heterologous nucleotide sequence including: (a) nucleotide sequence encoded by a polynucleotide donor molecule integrated by the methods disclosed herein at the site of a DSB in a genome, and (b) genomic nucleotide sequence adjacent to the site of the DSB. Related aspects include a plasmid, vector, or chromosome including such a heterologous nucleotide sequence, as well as polymerase primers for amplification (e. g., PCR amplification) of such a heterologous nucleotide sequence.

Compositions and Reaction Mixtures

In one aspect, the invention provides a composition including: (a) a cell; and (b) a polynucleotide (such as a double-stranded DNA, a single-stranded DNA, a single-stranded DNA/RNA hybrid, or a double-stranded DNA/RNA hybrid) donor molecule that is capable of being integrated (or having its sequence integrated) (preferably by non-homologous end-joining (NHEJ)) at one or more double-strand breaks in a genome in the cell. In many embodiments of the composition, the cell is a plant cell, e.

g., an isolated plant cell or a plant protoplast, or a plant cell in a plant, plant part, plant tissue, or callus. In certain embodiments, the cell is that of a photosynthetic eukaryote (e. g., green algae, red algae, diatoms, brown algae, and dinoflagellates).

In various embodiments of the composition, the plant cell is a plant cell or plant protoplast isolated from a whole plant or plant part or plant tissue (e. g., a plant cell or plant protoplast cultured in liquid medium or on solid medium), or a plant cell located in callus, an intact plant, seed, or seedling, or in a plant part or tissue. In embodiments, the plant cell is a cell of a monocot plant or of a dicot plant. In many embodiments, the plant cell is a plant cell capable of division and/or differentiation, including a plant cell capable of being regenerated into callus or a plant. In embodiments, the plant cell is capable of division and further differentiation, even capable of being regenerated into callus or into a plant. In embodiments, the plant cell is diploid, polyploid, or haploid (or can be induced to become haploid).

In embodiments, the composition includes a plant cell that includes at least one double-strand break (DSB) in its genome. Alternatively, the composition includes a plant cell in which at least one DSB will be induced in its genome, for example, by providing at least one DSB-inducing agent to the plant cell, e. g., either together with the polynucleotide (such as a double-stranded DNA, a single-stranded DNA, a single-stranded DNA/RNA hybrid, or a double-stranded DNA/RNA hybrid) donor molecule or separately. Thus, the composition optionally further includes at least one DSB-inducing agent. In embodiments, the composition optionally further includes at least one chemical, enzymatic, or physical delivery agent, or a combination thereof; such delivery agents and methods for their use are described in detail in the paragraphs following the heading "Delivery Methods and Delivery Agents". In embodiments, the DSB-inducing agent is at least one of the group consisting of:

(a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease;

(b) a polynucleotide encoding one or more nucleases capable of effecting site-specific alteration (such as introduction of a DSB) of a target nucleotide sequence; and (c) a guide RNA (gRNA) for an RNA-guided nuclease, or a DNA encoding a gRNA for an RNA-guided nuclease.

In embodiments, the composition includes (a) a cell; (b) a polynucleotide (such as a double-stranded DNA, a single-stranded DNA, a single-stranded DNA/RNA hybrid, or a double-stranded DNA/RNA hybrid) donor molecule, capable of being integrated (or having its sequence integrated) at a DSB; (c) a Cas9, a Cpf1, a CasY, a CasX, a C2c1, or a C2c3 nuclease; and (d) at least one guide RNA. In an embodiment, the composition includes (a) a cell; (b) a polynucleotide (such as a double-stranded DNA, a single-stranded DNA, a single-stranded DNA/RNA hybrid, or a double-stranded DNA/RNA hybrid) donor molecule, capable of being integrated (or having its sequence integrated) at a DSB; (c) at least one ribonucleoprotein including a CRISPR nuclease and a guide RNA.

In embodiments of the composition, the polynucleotide donor molecule is double-stranded and blunt-ended, or is double stranded and has an overhang or "sticky end" consisting of unpaired nucleotides (e. g., 1, 2, 3, 4, 5, or 6 unpaired nucleotides) at one terminus or both termini; in other embodiments, the polynucleotide donor molecule is a single-stranded DNA or a single-stranded DNA/RNA hybrid. In an embodiment, the polynucleotide donor molecule is a double-stranded DNA or DNA/RNA hybrid molecule that is blunt-ended or that has an overhang at one terminus or both termini, and that has about 18 to about 300 base-pairs, or about 20 to about 200 base-pairs, or about 30 to about 100 base-pairs, and having at least one phosphorothioate bond between adjacent nucleotides at a 5' end, 3' end, or both 5' and 3' ends. In embodiments, the polynucleotide donor molecule is a double-stranded DNA, a single-stranded DNA, a single-stranded DNA/RNA hybrid, or a double-stranded DNA/RNA hybrid, and includes single strands of at least 11, at least 18, at least 20, at least 30, at least 40, at least 60, at least 80, at least 100, at least 120, at least 140, at least 160, at least 180, at least 200, at least 240, at least 280, or at least 320 nucleotides. In embodiments, the polynucleotide donor molecule includes chemically modified nucleotides; in embodiments, the naturally occurring phosphodiester backbone of the polynucleotide molecule is partially or completely modified with phosphorothioate, phosphorodithioate, or methylphosphonate internucleotide linkage modifications, or the polynucleotide donor molecule includes modified nucleoside bases or modified sugars, or the polynucleotide donor molecule is labeled with a fluorescent moiety or other detectable label. In an embodiment, the polynucleotide donor molecule is double-stranded and perfectly base-paired through all or most of its length, with the possible exception of any unpaired nucleotides at either terminus or both termini. In another embodiment, the polynucleotide donor molecule is double-stranded and includes one or more non-terminal mismatches or non-terminal unpaired nucleotides within the otherwise double-stranded duplex. Other related embodiments include single- or double-stranded DNA/RNA hybrid donor molecules. Additional description of the polynucleotide donor molecule is found above in the paragraphs following the heading "Polynucleotide Molecules".

In embodiments of the composition, the polynucleotide donor molecule includes:

(a) a nucleotide sequence that is recognizable by a specific binding agent;

(b) a nucleotide sequence encoding an RNA molecule or an amino acid sequence that is recognizable by a specific binding agent;

(c) a nucleotide sequence that encodes an RNA molecule or an amino acid sequence that binds specifically to a ligand;

(d) a nucleotide sequence that is responsive to a specific change in the physical environment; or (e) a nucleotide sequence encoding an RNA molecule or an amino acid sequence that is responsive to a specific change in the physical environment;

(f) a nucleotide sequence encoding at least one stop codon on each strand;

(g) a nucleotide sequence encoding at least one stop codon within each reading frame on each strand; or (h) at least partially self-complementary sequence, such that the polynucleotide molecule encodes a transcript that is capable of forming at least partially double-stranded RNA; or (i) a combination of any of (a)-(h).

Additional description relating to these various embodiments of nucleotide sequences included in the polynucleotide donor molecule is found in the section headed "Methods of changing expression of a sequence of interest in a genome".

In another aspect, the invention provides a reaction mixture including: (a) a plant cell having a double-strand break (DSB) at at least one locus in its genome; and (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB (preferably by non-homologous end-joining (NHEJ)), with a length of between about 18 to about 300 base-pairs (or nucleotides, if single-stranded), or between about 30 to about 100 base-pairs(or nucleotides, if single-stranded); wherein sequence encoded by the polynucleotide donor molecule, if integrated at the DSB, forms a heterologous insertion (that is to say, resulting in a concatenated nucleotide sequence that is a combination of the sequence of the polynucleotide molecule and at least some of the genomic sequence adjacent to the site of DSB, wherein the concatenated sequence is heterologous, i. e., would not otherwise or does not normally occur at the site of insertion). In embodiments, the product of the reaction mixture includes a plant cell in which sequence encoded by the polynucleotide donor molecule has been integrated at the site of the DSB.

In many embodiments of the reaction mixture, the cell is a plant cell, e. g., an isolated plant cell or a plant protoplast, or a plant cell in a plant, plant part, plant tissue, or callus. In various embodiments of the reaction mixture, the plant cell is a plant cell or plant protoplast isolated from a whole plant or plant part or plant tissue (e. g., a plant cell or plant protoplast cultured in liquid medium or on solid medium), or a plant cell located in callus, an intact plant, seed, or seedling, or in a plant part or tissue. In embodiments, the plant cell is a cell of a monocot plant or of a dicot plant. In many embodiments, the plant cell is a plant cell capable of division and/or differentiation, including a plant cell capable of being regenerated into callus or a plant. In embodiments, the plant cell is capable of division and further differentiation, even capable of being regenerated into callus or into a plant. In embodiments, the plant cell is diploid, polyploid, or haploid (or can be induced to become haploid).

In embodiments, the reaction mixture includes a plant cell that includes at least one double-strand break (DSB) in its genome. Alternatively, the reaction mixture includes a plant cell in which at least one DSB will be induced in its genome, for example, by providing at least one DSB-inducing agent to the plant cell, e. g., either together with a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB, or separately. Thus, the reaction mixture optionally further includes at least one DSB-inducing agent. In embodiments, the reaction mixture optionally further includes at least one chemical, enzymatic, or physical delivery agent, or a combination thereof; such delivery agents and methods for their use are described in detail in the paragraphs following the heading "Delivery Methods and Delivery Agents". In embodiments, the DSB-inducing agent is at least one of the group consisting of:

(a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease;

(b) a polynucleotide encoding one or more nucleases capable of effecting site-specific alteration (such as introduction of a DSB) of a target nucleotide sequence; and (c) a guide RNA (gRNA) for an RNA-guided nuclease, or a DNA encoding a gRNA for an RNA-guided nuclease.

In embodiments, the reaction mixture includes (a) a plant cell; (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB; (c) a Cas9, a Cpf1, a CasY, a CasX, a C2c1, or a C2c3 nuclease; and (d) at least one guide RNA. In an embodiment, the reaction mixture includes (a) a plant cell or a plant protoplast; (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB; (c) at least one ribonucleoprotein including a CRISPR nuclease and a guide RNA. In an embodiment, the reaction mixture includes (a) plant cell or a plant protoplast; (b) a polynucleotide (such as a double-stranded DNA, a single-stranded DNA, a single-stranded DNA/RNA hybrid, or a double-stranded DNA/RNA hybrid) donor molecule capable of being integrated or inserted (or having its sequence integrated or inserted) at the DSB; (c) at least one ribonucleoprotein including Cas9 and an sgRNA.

In embodiments of the reaction mixture, the polynucleotide (such as a double-stranded DNA, a single-stranded DNA, a single-stranded DNA/RNA hybrid, or a double-stranded DNA/RNA hybrid) donor molecule includes:

(a) a nucleotide sequence that is recognizable by a specific binding agent;

(b) a nucleotide sequence encoding an RNA molecule or an amino acid sequence that is recognizable by a specific binding agent;

(c) a nucleotide sequence that encodes an RNA molecule or an amino acid sequence that binds specifically to a ligand;

(d) a nucleotide sequence that is responsive to a specific change in the physical environment; or (e) a nucleotide sequence encoding an RNA molecule or an amino acid sequence that is responsive to a specific change in the physical environment;

(f) a nucleotide sequence encoding at least one stop codon on each strand;

(g) a nucleotide sequence encoding at least one stop codon within each reading frame on each strand; or (h) at least partially self-complementary sequence, such that the polynucleotide molecule encodes a transcript that is capable of forming at least partially double-stranded RNA; or (i) a combination of any of (a)-(h).

Additional description relating to these various embodiments of nucleotide sequences included in the polynucleotide donor molecule is found in the section headed "Methods of changing expression of a sequence of interest in a genome".

Polynucleotides for Disrupting Gene Expression

In another aspect, the invention provides a polynucleotide (such as a double-stranded DNA, a single-stranded DNA, single-stranded DNA/RNA hybrid, or a double-stranded DNA/RNA hybrid) molecule for disrupting gene expression, including double-stranded polynucleotides containing at least 18 base-pairs and encoding at least one stop codon in each possible reading frame on each strand and single-stranded polynucleotides containing at least 11 contiguous nucleotides and encoding at least one stop codon in each possible reading frame on the strand. Such a stop-codon-containing polynucleotide, when integrated or inserted at the site of a DSB in a genome, disrupts or hinders translation of an encoded amino acid sequence. In embodiments, the polynucleotide is a double-stranded DNA or double-stranded DNA/RNA hybrid molecule including at least 18 contiguous base-pairs and encoding at least one stop codon in each possible reading frame on either strand; in embodiments, the polynucleotide is a double-stranded DNA or double-stranded DNA/RNA hybrid molecule that is blunt-ended; in other embodiments, the polynucleotide is a double-stranded DNA or double-stranded DNA/RNA hybrid molecule that has one or more overhangs or unpaired nucleotides at one or both termini. In embodiments, the polynucleotide is double-stranded and includes between about 18 to about 300 nucleotides on each strand. In embodiments, the polynucleotide is a single-stranded DNA or a single-stranded DNA/RNA hybrid molecule including at least 11 contiguous nucleotides and encoding at least one stop codon in each possible reading frame on the strand. In embodiments, the polynucleotide is single-stranded and includes between 11 and about 300 contiguous nucleotides in the strand.

In embodiments, the polynucleotide for disrupting gene expression further includes a nucleotide sequence that provides a useful function when integrated into the site of a DSB in a genome. For example, in various non-limiting embodiments the polynucleotide further includes: sequence that is recognizable by a specific binding agent or that binds to a specific molecule or encodes an RNA molecule or an amino acid sequence that binds to a specific molecule, or sequence that is responsive to a specific change in the physical environment or encodes an RNA molecule or an amino acid sequence that is responsive to a specific change in the physical environment, or heterologous sequence, or sequence that serves to stop transcription at the site of the DSB, or sequence having secondary structure (e. g., double-stranded stems or stem-loops) or than encodes a transcript having secondary structure (e. g., double-stranded RNA that is cleavable by a Dicer-type ribonuclease).

In an embodiment, the polynucleotide for disrupting gene expression is a double-stranded DNA or a double-stranded DNA/RNA hybrid molecule, wherein each strand of the polynucleotide includes at least 18 and fewer than 200 contiguous base-pairs, wherein the number of base-pairs is not divisible by 3, and wherein each strand encodes at least one stop codon in each possible reading frame in the 5' to 3' direction. In an embodiment, the polynucleotide is a double-stranded DNA or a double-stranded DNA/RNA hybrid molecule, wherein the polynucleotide includes at least one phosphorothioate modification.

Related aspects include larger polynucleotides such as a plasmid, vector, or chromosome including the polynucleotide for disrupting gene expression, as well as polymerase primers for amplification of the polynucleotide for disrupting gene expression.

Methods of Identifying the Locus of a Double-Stranded Break

In another aspect, the invention provides a method of identifying the locus of at least one double-stranded break (DSB) in genomic DNA in a cell (such as a plant cell or plant protoplast) including the genomic DNA, the method including: (a) contacting the genomic DNA having a DSB with a polynucleotide (such as a double-stranded DNA, a single-stranded DNA, a single-stranded DNA/RNA hybrid, or a double-stranded DNA/RNA hybrid) molecule, wherein the polynucleotide donor molecule is capable of being integrated (or having its sequence integrated) at the DSB and has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded); wherein sequence encoded by the polynucleotide donor molecule, if integrated at the DSB, forms a heterologous insertion; and (b) using at least part of the sequence encoded by the polynucleotide molecule as a target for PCR primers to allow amplification of DNA in the locus of the double-stranded break. In embodiments, the genomic DNA is that of a nucleus, mitochondrion, or plastid. In embodiments, the DSB locus is identified by amplification using primers specific for DNA sequence encoded by the polynucleotide molecule alone; in other embodiments, the DSB locus is identified by amplification using primers specific for a combination of DNA sequence encoded by the polynucleotide donor molecule and genomic DNA sequence flanking the DSB. Such identification using a heterologously integrated DNA sequence (i. e., that encoded by the polynucleotide molecule) is useful, e. g., to distinguish a cell (such as a plant cell or plant protoplast) containing sequence encoded by the polynucleotide molecule integrated at the DSB from a cell that does not. Identification of an edited genome from a non-edited genome is important for various purposes, e. g., for commercial or regulatory tracking of cells or biological material such as plants or seeds containing an edited genome.

In a related aspect, the invention provides a method of identifying the locus of double-stranded breaks (DSBs) in genomic DNA in a pool of cells (such as a pool of plant cells or plant protoplasts), wherein the pool of cells includes cells having genomic DNA with sequence encoded by a polynucleotide (such as a double-stranded DNA, a single-stranded DNA, a single-stranded DNA/RNA hybrid, or a double-stranded DNA/RNA hybrid) donor molecule inserted at the locus of the double stranded breaks; wherein the polynucleotide donor molecule is capable of being integrated (or having its sequence integrated) at the DSB and has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded); wherein sequence encoded by the polynucleotide donor molecule, if integrated at the DSB, forms a heterologous insertion; wherein the sequence encoded by the polynucleotide molecule is used as a target for PCR primers to allow amplification of DNA in the region of the double-stranded breaks. In embodiments, the genomic DNA is that of a nucleus, mitochondrion, or plastid. In embodiments, the pool of cells is a population of plant cells or plant protoplasts, wherein the population of plant cells or plant protoplasts include multiple different DSBs (e. g., induced by different guide RNAs) in the genome. In embodiments, each DSB locus is identified by amplification using primers specific for DNA sequence encoded by the polynucleotide molecule alone; in other embodiments, each DSB locus is identified by amplification using primers specific for a combination of DNA sequence encoded by the polynucleotide molecule and genomic DNA sequence flanking the DSB. Such identification using a heterologously integrated DNA sequence (i. e., sequence encoded by the polynucleotide molecule) is useful, e. g., to identify a cell (such as a plant cell or plant protoplast) containing sequence encoded by the polynucleotide molecule integrated at a DSB from a cell that does not.

In embodiments, the pool of cells is a pool of isolated plant cells or plant protoplasts in liquid or suspension culture, or cultured in or on semi-solid or solid media. In embodiments, the pool of cells is a pool of plant cells or plant protoplasts encapsulated in a polymer or other encapsulating material, enclosed in a vesicle or liposome, or embedded in or attached to a matrix or other solid support (e. g., beads or microbeads, membranes, or solid surfaces). In embodiments, the pool of cells is a pool of plant cells or plant protoplasts encapsulated in a polysaccharide (e. g., pectin, agarose). In embodiments, the pool of cells is a pool of plant cells located in a plant, plant part, or plant tissue, and the cells are optionally isolated from the plant, plant part, or plant tissue in a step following the integration of a polynucleotide at a DSB.

In embodiments, the polynucleotide donor molecule that is integrated (or has sequence that is integrated) at the DSB is double-stranded and blunt-ended; in other embodiments the polynucleotide donor molecule is double-stranded and has an overhang or "sticky end" consisting of unpaired nucleotides (e. g., 1, 2, 3, 4, 5, or 6 unpaired nucleotides) at one terminus or both termini. In an embodiment, the polynucleotide donor molecule that is integrated (or has sequence that is integrated) at the DSB is a double-stranded DNA or double-stranded DNA/RNA hybrid molecule of about 18 to about 300 base-pairs, or about 20 to about 200 base-pairs, or about 30 to about 100 base-pairs, and having at least one phosphorothioate bond between adjacent nucleotides at a 5' end, 3' end, or both 5' and 3' ends. In embodiments, the polynucleotide donor molecule includes single strands of at least 11, at least 18, at least 20, at least 30, at least 40, at least 60, at least 80, at least 100, at least 120, at least 140, at least 160, at least 180, at least 200, at least 240, at least 280, or at least 320 nucleotides. In embodiments, the polynucleotide donor molecule has a length of at least 2, at least 3, at least 4, at least 5, at least 6, at least 7, at least 8, at least 9, at least 10, or at least 11 base-pairs if double-stranded (or nucleotides if single-stranded), or between about 2 to about 320 base-pairs if double-stranded (or nucleotides if single-stranded), or between about 2 to about 500 base-pairs if double-stranded (or nucleotides if single-stranded), or between about 5 to about 500 base-pairs if double-stranded (or nucleotides if single-stranded), or between about 5 to about 300 base-pairs if double-stranded (or nucleotides if single-stranded), or between about 11 to about 300 base-pairs if double-stranded (or nucleotides if single-stranded), or about 18 to about 300 base-pairs if double-stranded (or nucleotides if single-stranded), or between about 30 to about 100 base-pairs if double-stranded (or nucleotides if single-stranded). In embodiments, the polynucleotide donor molecule includes chemically modified nucleotides; in embodiments, the naturally occurring phosphodiester backbone of the polynucleotide donor molecule is partially or completely modified with phosphorothioate, phosphorodithioate, or methylphosphonate internucleotide linkage modifications, or the polynucleotide donor molecule includes modified nucleoside bases or modified sugars, or the polynucleotide donor molecule is labeled with a fluorescent moiety or other detectable label. In an embodiment, the polynucleotide donor molecule is double-stranded and is perfectly base-paired through all or most of its length, with the possible exception of any unpaired nucleotides at either terminus or both termini. In another embodiment, the polynucleotide donor molecule is double-stranded and includes one or more non-terminal mismatches or non-terminal unpaired nucleotides within the otherwise double-stranded duplex. In related embodiments, the polynucleotide donor molecule that is integrated at the DSB is a single-stranded DNA or a single-stranded DNA/RNA hybrid. Additional description of the polynucleotide donor molecule is found above in the paragraphs following the heading "Polynucleotide Molecules".

In embodiments, the polynucleotide (such as a double-stranded DNA, a single-stranded DNA, a single-stranded DNA/RNA hybrid, or a double-stranded DNA/RNA hybrid) donor molecule that is integrated at the DSB includes a nucleotide sequence that, if integrated (or has sequence that is integrated) at the DSB, forms a heterologous insertion that is not normally found in the genome. In embodiments, sequence encoded by the polynucleotide molecule that is integrated at the DSB includes a nucleotide sequence that does not normally occur in the genome containing the DSB; this can be established by sequencing of the genome, or by hybridization experiments. In certain embodiments, sequence encoded by the polynucleotide molecule, when integrated at the DSB, not only permits identification of the locus of the DSB, but also imparts a functional trait to the cell including the genomic DNA, or to an organism including the cell; in non-limiting examples, sequence encoded by the polynucleotide molecule that is integrated at the DSB includes at least one of the nucleotide sequences selected from the group consisting of:

(a) DNA encoding at least one stop codon, or at least one stop codon on each strand, or at least one stop codon within each reading frame on each strand;

(b) DNA encoding heterologous primer sequence (e. g., a sequence of about 18 to about 22 contiguous nucleotides, or of at least 18, at least 20, or at least 22 contiguous nucleotides that can be used to initiate DNA polymerase activity at the site of the DSB);

(c) DNA encoding a unique identifier sequence (e. g., a sequence that when inserted at the DSB creates a heterologous sequence that can be used to identify the presence of the insertion);

(d) DNA encoding a transcript-stabilizing sequence;

(e) DNA encoding a transcript-destabilizing sequence;

(f) a DNA aptamer or DNA encoding an RNA aptamer or amino acid aptamer; and (g) DNA that includes or encodes a sequence recognizable by a specific binding agent.

Methods of Identifying the Nucleotide Sequence of a Locus in the Genome that is Associated with a Phenotype In another aspect, the invention provides a method of identifying the nucleotide sequence of a locus in the genome that is associated with a phenotype, the method including the steps of:

(a) providing to a population of cells (such as plant cells or plant protoplasts) having the genome:

(i) multiple different guide RNAs (gRNAs) to induce multiple different double strand breaks (DSBs) in the genome, wherein each DSB is produced by an RNA-guided nuclease guided to a locus on the genome by one of the gRNAs, and (ii) polynucleotide (such as a double-stranded DNA, a single-stranded DNA, a single-stranded DNA/RNA hybrid, or a double-stranded DNA/RNA hybrid) donor molecules having a defined nucleotide sequence, wherein the polynucleotide molecules are capable of being integrated (or have sequence that is integrated) into the DSBs by non-homologous end-joining (NHEJ);

whereby when sequence encoded by at least some of the polynucleotide molecules are inserted into at least some of the DSBs, a genetically heterogeneous population of cells is produced;

(b) selecting from the genetically heterogeneous population of cells a subset of cells that exhibit a phenotype of interest;

(c) using a pool of PCR primers that bind to sequence encoded by the polynucleotide molecules to amplify from the subset of cells DNA from the locus of a DSB into which sequence encoded by one of the polynucleotide molecules has been inserted; and (d) sequencing the amplified DNA to identify the locus associated with the phenotype of interest.

In embodiments, the cells are plant cells or plant protoplasts or algal cells. In embodiments, the genetically heterogeneous population of cells undergoes one or more doubling cycles; for example, the population of cells is provided with growth conditions that should normally result in cell division, and at least some of the cells undergo one or more doublings. In embodiments, the genetically heterogeneous population of cells is subjected to conditions permitting expression of the phenotype of interest. In embodiments, the cells are provided in a single pool or population (e. g., in a single container); in other embodiments, the cells are provided in an arrayed format (e. g., in microwell plates or in droplets in a microfluidics device or attached individually to particles or beads).

In embodiments, the RNA-guided nuclease or a polynucleotide that encodes the RNA-guided nuclease is exogenously provided to the population of cells. In embodiments, each gRNA is provided as a polynucleotide composition including: (a) a CRISPR RNA (crRNA) that includes the gRNA, or a polynucleotide that encodes a crRNA, or a polynucleotide that is processed into a crRNA; or (b) a single guide RNA (sgRNA) that includes the gRNA, or a polynucleotide that encodes a sgRNA, or a polynucleotide that is processed into a sgRNA In embodiments, the multiple guide RNAs are provided as ribonucleoproteins (e. g., Cas9 nuclease molecules complexed with different gRNAs to form different RNPs). In embodiments, each gRNA is provided as a ribonucleoprotein (RNP) including the RNA-guided nuclease and an sgRNA. In embodiments, multiple guide RNAs are provided, as well as a single polynucleotide donor molecule having a sequence to be integrated at the resulting DSBs; in other embodiments, multiple guide RNAs are provided, as well as different polynucleotide donor molecules having a sequence to be integrated at the resulting multiple DSBs.

The foregoing description and the non-limiting examples presented in this disclosure illustrate the subject matter of this invention. Embodiments within the scope of this invention include those described in the following numbered list of embodiments.

(Embodiment 1) A modified *Zea* sp. cell, wherein the modified cell includes a targeted modification in at least one gene selected from Table 23, or in a regulatory sequence affecting the expression of the gene. (Embodiment 2) The modified cell of embodiment 1, wherein the gene is associated with a trait, and wherein the trait is selected from the group consisting of abiotic stress, architecture, biotic stress, nutrient use efficiency, photosynthesis, resource partitioning, and senescence, and wherein the modification improves the trait in a cell including the modification relative to a cell lacking the modification, or in a plant grown from a cell including the modification relative to a plant lacking the modification. (Embodiment 3) The modified cell of embodiment 1, wherein the gene lacking the targeted modification is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identical to a nucleic acid sequence listed in Table 23. (Embodiment 4) The modified cell of embodiment 1, wherein the targeted gene encodes a protein, and wherein the amino acid sequence of the protein before targeting is at least 90%, at least 91%, at least 92%, at least 93%, at least 94%, at least 95%, at least 96%, at least 97%, at least 98%, at least 99% or 100% identical to the amino acid sequence of a protein listed in Table 23. (Embodiment 5) The modified cell of any of embodiments 1-4, wherein the at least one targeted modification results in increased expression of a gene; decreased expression of a gene; a change in the coding sequence of the modified gene; a change in expression or activity of the modified gene; or a change in expression, stability or activity of a protein or mRNA encoded by the modified gene. (Embodiment 6) The modified cell of any of embodiments 1-4, wherein the at least one targeted modification includes a modification selected from the group consisting of: insertion of a nucleotide sequence encoded by a polynucleotide donor molecule; deletion of genomic sequence at a double-strand break in the genome or between multiple double-strand breaks in the genome; and a change in nucleic acid or amino acid sequence. (Embodiment 7) The modified cell of embodiment 6, wherein the insertion includes or creates an upregulatory sequence. (Embodiment 8) The modified cell of embodiment 6, wherein the insertion includes or creates a down-regulatory sequence. (Embodiment 9) The modified cell of any of embodiments 1-6, wherein the modification knocks out expression of the modified gene. (Embodiment 10) The modified cell of any of embodiments 1-6, wherein the modification improves mRNA translation efficiency. (Embodiment 11) The modified cell of any of embodiments 1-6, wherein the modification results in diminished mRNA translation efficiency. (Embodiment 12) The modified cell of any of embodiments 1-6, wherein the modification is an epigenetic modification. (Embodiment 13) The modified cell of any of embodiments 1-6, wherein the modification includes the insertion or creation of at least one transcription factor binding site. (Embodiment 14) The modified cell of any of embodiments 1-6, wherein the at least one modification includes an insertion, and wherein the insertion is accompanied by the deletion of sequences from the genome of the cell. (Embodiment 15) The modified cell of any of embodiments 1-6, wherein the at least one modification includes an insertion, and wherein the insertion is in a region of the genome that is recalcitrant to meiotic or mitotic recombination. (Embodiment 16) The modified cell of any of embodiments 1-6, wherein the at least one modification is an introduced sequence selected from the following: a. a sequence encoding at least one stop codon, or at least one stop codon on each strand, or at least one stop codon within each reading frame on each strand; b. a heterologous primer sequence; c. a unique identifier sequence; d. a transcript-stabilizing sequence; e. a transcript-destabilizing sequence; f. a sequence encoding an RNA aptamer or an amino acid aptamer; and g. a sequence recognizable by a specific RNA or DNA binding agent. (Embodiment 17) The modified cell of embodiment 16, wherein the at least one modification is the introduction of a sequence recognizable by a specific binding agent, and wherein contacting the sequence with the specific binding agent results in a change of expression of a sequence of interest. (Embodiment 18) The modified cell of embodiment 17, wherein: (a) the sequence recognizable by a specific binding agent includes an auxin response element sequence, the specific binding agent is an auxin, and the change of expression is upregulation; (b) the sequence recognizable by a specific binding agent includes at least one D1-4 sequence, the specific binding agent is an auxin, and the change of expression is upregulation; (c) the sequence recognizable by a specific binding agent includes at least one DR5 sequence, the specific binding agent is an auxin, and the change of expression is upregulation; (d) the sequence recognizable by a specific binding agent includes at least one m5-DR5 sequence, the specific binding agent is an auxin, and the change of expression is upregulation; (e) the sequence recognizable by a specific binding agent includes at least one P3 sequence, the specific binding agent is an auxin, and the change of expression is upregulation; (f) the sequence recognizable by a specific binding agent includes a small RNA recognition site sequence, the specific binding agent is the corresponding small RNA, and the change of expression is downregulation; (g) the sequence recognizable by a specific binding agent includes a microRNA (miRNA) recognition site sequence, the specific binding agent is the corresponding mature miRNA, and the change of expression is downregulation; (h) the sequence recognizable by a specific binding agent includes a microRNA (miRNA) recognition site sequence for an engineered miRNA, the specific binding agent is the corresponding engineered mature miRNA, and the change of expression is downregulation; (i) the sequence recognizable by a specific binding agent includes a transposon recognition sequence, the specific binding agent is the corresponding transposon, and the change of expression is upregulation or downregulation; (j) the sequence recognizable by a specific binding agent includes an ethylene-responsive element binding-factor-associated amphiphilic repression (EAR) motif sequence, the specific binding agent is ERF (ethylene-responsive element binding factor) or co-repressor, and the change of expression is downregulation; (k) the sequence recognizable by a specific binding agent includes a splice site sequence, the specific binding agent is a spliceosome, and the change of expression is expression of a spliced transcript; (l) the sequence recognizable by a specific binding agent includes a site-specific recombinase recognition site sequence, the specific binding agent is the corresponding site-specific recombinase, and the change of expression is upregulation or downregulation or expression of a transcript having an altered sequence; (m) the sequence recognizable by a specific binding agent includes sequence encoding an RNA aptamer or an RNA riboswitch, the specific binding agent is the corresponding ligand, and the change in expression is upregulation or downregulation; (n) the sequence recognizable by a specific binding agent is a hormone responsive element, the specific binding agent is a hormone, and the change in expression is upregulation or downregulation; or (o) the sequence recognizable by a specific binding agent is a transcription factor binding sequence, the specific binding agent is the corresponding transcription factor, and the change in expression is upregulation or downregulation. (Embodiment 19) The modified cell of embodiment 18, wherein the modification includes the introduction of a nucleotide sequence that encodes an RNA molecule or an amino acid sequence that is recognizable by a specific binding agent. (Embodiment 20) The modified cell of embodiment 18, wherein the modification includes the introduction of a nucleotide sequence that encodes an RNA molecule or an amino acid sequence that binds specifically to a ligand. (Embodiment 21) The modified cell of embodiment 18, wherein the modified gene encodes at least one stop codon on each strand. (Embodiment 22) The modified cell of embodiment 18, wherein the modified gene encodes at least one stop codon within each reading frame on each strand. (Embodiment 23) The modified cell of embodiment 18, wherein the modified gene encodes a transcript that is capable of forming at least partially double-stranded RNA. (Embodiment 24) The modified cell of embodiment 18, wherein the modified gene includes a nucleotide sequence that is responsive to a specific change in the physical environment, and wherein exposing the integrated polynucleotide molecule to the specific change in the physical environment results in a change of expression of a sequence of interest. (Embodiment 25) The modified cell of embodiment 24, wherein the specific change in the physical environment is at least one of: a change in light intensity or quality, a change in temperature, a change in pressure, a change in osmotic concentration, or a change in day length. (Embodiment 26) The modified cell of embodiment 25, wherein the modified gene encodes a Light-Oxygen-Voltage domain (Embodiment 27) The modified cell of any of embodiments 1-26, wherein the modified cell includes an inserted regulatory sequence selected from the sequences listed in Table 24. (Embodiment 28) The modified cell of any of embodiments 1-27, wherein the modified Zea sp. cell is an isolated cell or protoplast. (Embodiment 29) The modified cell of any of embodiments 1-27, wherein the modified Zea sp. cell is in a Zea sp. plant, or in a zygotic or somatic embryo, seed, part, or tissue of a Zea sp. plant. (Embodiment 30) The modified cell of any of embodiments 1-27, wherein the modified Zea sp. cell is capable of division or differentiation. (Embodiment 31) The modified cell of any of embodiments 1-27, wherein the modified Zea sp. cell is haploid, diploid, or polyploid. (Embodiment 32) The modified cell of any of embodiments 1-27, wherein the modified Zea sp. cell is a meristematic cell, embryonic cell, or germline cell. (Embodiment 33) The modified cell of any of embodiments 1-32, wherein the modification is determined relative to a parent plant cell, and wherein the modified plant cell is devoid of mitotically or meiotically generated genetic or epigenetic changes relative to the parent plant cell. (Embodiment 34) The modified cell of any of embodiments 1-26, wherein the modified cell includes an inserted regulatory sequence selected from the sequences listed in Table 24. (Embodiment 35) A modified Zea sp. cell, wherein the modified cell includes an inserted regulatory sequence selected from the sequences listed in Table 24. (Embodiment 36) A modified *Zea* sp. cell, wherein the modified cell includes two or more targeted modifications, wherein at least one of said targeted modifications occurs in a gene selected from the list of genes in Table 23 or in a regulatory sequence affecting the expression of the gene. (Embodiment 37) The modified cell of embodiment 36, wherein the gene is associated with a trait, and wherein the trait is selected from the group consisting of abiotic stress, architecture, biotic stress, nutrient use efficiency, photosynthesis, resource partitioning, and senescence, and wherein the modification improves the trait in a cell including the modification relative to a cell lacking the modification, or in a plant grown from a cell including the modification relative to a plant lacking the modification. (Embodiment 38) The modified cell of embodiment 36, wherein a targeted gene, before modification, is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identical to a nucleic acid sequence listed in Table 23. (Embodiment 39) The modified cell of embodiment 36, wherein a targeted gene encodes a protein, and wherein the amino acid sequence of the encoded protein before targeting is at least 90%, at least 91%, at least 92%, at least 93%, at least 94%, at least 95%, at least 96%, at least 97%, at least 98%, at least 99% or 100% identical to the amino acid sequence of a protein listed in Table 23. (Embodiment 40) The modified cell of any of embodiments 36-39, wherein the targeted modifications result in increased expression of a gene; decreased expression of a gene; a change in the coding sequence of the modified gene; a change in expression or activity of the modified gene; or a change in expression, stability or activity of a protein or mRNA encoded by the modified gene. (Embodiment 41) The modified cell of any of embodiments 36-39, wherein the targeted modifications includes a modification selected from the group consisting of: insertion of a nucleotide sequence encoded by a polynucleotide donor molecule; deletion of genomic sequence at a double-strand break in the genome or between multiple double-strand breaks in the genome; and a change in nucleic acid or amino acid sequence. (Embodiment 42) The modified cell of embodiment 41, wherein the insertion includes or creates an upregulatory sequence. (Embodiment 43) The modified cell of embodiment 41, wherein the insertion includes or creates a down-regulatory sequence. (Embodiment 44) The modified cell of any of embodiments 36-41, wherein at least one the modifications knocks out expression of the modified gene. (Embodiment 45) The modified cell of any of embodiments 36-41, wherein at least one of the modifications improves mRNA translation efficiency. (Embodiment 46) The modified cell of any of embodiments 36-41, wherein at least one of the modifications results in diminished mRNA translation efficiency. (Embodiment 47) The modified cell of any of embodiments 36-41, wherein at least one of the modifications is an epigenetic modification. (Embodiment 48) The modified cell of any of embodiments 36-41, wherein at least one of the modifications includes the insertion or creation of at least one transcription factor binding site. (Embodiment 49) The modified cell of any of embodiments 36-41, wherein at least one of the modifications includes an insertion, and wherein the insertion is accompanied by the deletion of sequences from the genome of the cell. (Embodiment 50) The modified cell of any of embodiments 36-41, wherein at least one of the modifications includes an insertion, and wherein the insertion is in a region of the genome that is recalcitrant to meiotic or mitotic recombination. (Embodiment 51) The modified cell of any of embodiments 36-41, wherein at least one of the modifications is an introduced sequence selected from the following: a. a sequence encoding at least one stop codon, or at least one stop codon on each strand, or at least one stop codon within each reading frame on each strand; b. a heterologous primer sequence; c. a unique identifier sequence; d. a transcript-stabilizing sequence; e. a transcript-destabilizing sequence; f. a sequence encoding an RNA aptamer or an amino acid aptamer; and g. a sequence recognizable by a specific RNA or DNA binding agent. (Embodiment 52) The modified cell of embodiment 51, wherein at least one of the modifications is the introduction of a sequence recognizable by a specific binding agent, and wherein contacting the sequence with the specific binding agent results in a change of expression of a sequence of interest. (Embodiment 53) The modified cell of embodiment 52, wherein: (a) the sequence recognizable by a specific binding agent includes an auxin response element sequence, the specific binding agent is an auxin, and the change of expression is upregulation; (b) the sequence recognizable by a specific binding agent includes at least one D1-4 sequence, the specific binding agent is an auxin, and the change of expression is upregulation; (c) the sequence recognizable by a specific binding agent includes at least one DR5 sequence, the specific binding agent is an auxin, and the change of expression is upregulation; (d) the sequence recognizable by a specific binding agent includes at least one m5-DR5 sequence, the specific binding agent is an auxin, and the change of expression is upregulation; (e) the sequence recognizable by a specific binding agent includes at least one P3 sequence, the specific binding agent is an auxin, and the change of expression is upregulation; (f) the sequence recognizable by a specific binding agent includes a small RNA recognition site sequence, the specific binding agent is the corresponding small RNA, and the change of expression is downregulation; (g) the sequence recognizable by a specific binding agent includes a microRNA (miRNA) recognition site sequence, the specific binding agent is the corresponding mature miRNA, and the change of expression is downregulation; (h) the sequence recognizable by a specific binding agent includes a microRNA (miRNA) recognition site sequence for an engineered miRNA, the specific binding agent is the corresponding engineered mature miRNA, and the change of expression is downregulation; (i) the sequence recognizable by a specific binding agent includes a transposon recognition sequence, the specific binding agent is the corresponding transposon, and the change of expression is upregulation or downregulation; (j) the sequence recognizable by a specific binding agent includes an ethylene-responsive element binding-factor-associated amphiphilic repression (EAR) motif sequence, the specific binding agent is ERF (ethylene-responsive element binding factor) or co-repressor, and the change of expression is downregulation; (k) the sequence recognizable by a specific binding agent includes a splice site sequence, the specific binding agent is a spliceosome, and the change of expression is expression of a spliced transcript; (l) the sequence recognizable by a specific binding agent includes a site-specific recombinase recognition site sequence, the specific binding agent is the corresponding site-specific recombinase, and the change of expression is upregulation or downregulation or expression of a transcript having an altered sequence; (m) the sequence recognizable by a specific binding agent includes sequence encoding an RNA aptamer or an RNA riboswitch, the specific binding agent is the corresponding ligand, and the change in expression is upregulation or downregulation; (n) the sequence recognizable by a specific binding agent is a hormone responsive element, the specific binding agent is a hormone, and the change in expression is upregulation or downregulation; or (o) the sequence recognizable by a specific binding agent is a transcription factor binding sequence, the specific binding agent is the corresponding transcription factor, and the change in expression is upregulation or downregulation. (Embodiment 54) The modified cell of embodiment 53, wherein at least one modification includes the introduction of a nucleotide sequence that encodes an RNA molecule or an amino acid sequence that is recognizable by a specific binding agent. (Embodiment 55) The modified cell of embodiment 53, wherein at least one modification includes the introduction of a nucleotide sequence that encodes an RNA molecule or an amino acid sequence that binds specifically to a ligand. (Embodiment 56) The modified cell of embodiment 53, wherein the modified gene encodes at least one stop codon on each strand. (Embodiment 57) The modified cell of embodiment 53, wherein the modified gene encodes at least one stop codon within each reading frame on each strand. (Embodiment 58) The modified cell of embodiment 53, wherein the modified gene encodes a transcript that is capable of forming at least partially double-stranded RNA. (Embodiment 59) The modified cell of embodiment 53, wherein the modified gene includes a nucleotide sequence that is responsive to a specific change in the physical environment, and wherein exposing the integrated polynucleotide molecule to the specific change in the physical environment results in a change of expression of a sequence of interest. (Embodiment 60) The modified cell of embodiment 59, wherein the specific change in the physical environment is at least one of: a change in light intensity or quality, a change in temperature, a change in pressure, a change in osmotic concentration, or a change in day length. (Embodiment 61) The modified cell of embodiment 60, wherein the modified gene encodes a Light-Oxygen-Voltage domain (Embodiment 62) The modified cell of any of embodiments 36-61, wherein the modified cell includes an inserted regulatory sequence selected from the sequences listed in Table 24. (Embodiment 63) The modified cell of any of embodiments 36-62, wherein the modified *Zea* sp. cell is an isolated cell or protoplast. (Embodiment 64) The modified cell of any of embodiments 36-62, wherein the modified *Zea* sp. cell is in a *Zea* sp. plant, or in a zygotic or somatic embryo, seed, part, or tissue of a *Zea* sp. plant. (Embodiment 65) The modified cell of any of embodiments 36-62, wherein the modified *Zea* sp. cell is capable of division or differentiation. (Embodiment 66) The modified cell of any of embodiments 36-62, wherein the modified *Zea* sp. cell is haploid, diploid, or polyploid. (Embodiment 67) The modified cell of any of embodiments 36-62, wherein the modified *Zea* sp. cell is a meristematic cell, embryonic cell, or germline cell. (Embodiment 68) The modified cell of any of embodiments 36-67, wherein the modifications are determined relative to a parent plant cell, and wherein the modified plant cell is devoid of mitotically or meiotically generated genetic or epigenetic changes relative to the parent plant cell. (Embodiment 69) A modified *Zea* sp. cell, wherein the modified cell includes two or more targeted modifications, wherein a first targeted modification occurs in a first gene from Table 23, and wherein a second modification occurs in second gene from Table 23, and wherein said modifications are associated with different traits. (Embodiment 70) The modified cell of embodiment 69, wherein the traits are selected from the group consisting of abiotic stress, architecture, biotic stress, nutrient use efficiency, photosynthesis, resource partitioning, and senescence, and wherein the modification improves the traits in a cell including the modification relative to a cell lacking the modification, or in a plant grown from a cell including the modification relative to a plant lacking the modification. (Embodiment 71) The modified cell of embodiment 69, wherein at least one of the targeted genes, before modification, is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99% or 100% identical to a nucleic acid sequence listed in Table 23. (Embodiment 72) The modified cell of embodiment 69, wherein at least one of the targeted genes encodes a protein, and wherein the amino acid sequence of the protein before targeting is at least 90%, at least 91%, at least 92%, at least 93%, at least 94%, at least 95%, at least 96%, at least 97%, at least 98%, at least 99% or 100% identical to the amino acid sequence of a protein listed in Table 23. (Embodiment 73) The modified cell of any of embodiments 69-72, wherein the targeted modifications result in increased expression of a gene; decreased expression of a gene; a change in the coding sequence of the modified gene; a change in expression or activity of the modified gene; or a change in expression, stability or activity of a protein or mRNA encoded by the modified gene. (Embodiment 74) The modified cell of any of embodiments 69-72, wherein the targeted modifications includes a modification selected from the group consisting of: insertion of a nucleotide sequence encoded by a polynucleotide donor molecule; deletion of genomic sequence at a double-strand break in the genome or between multiple double-strand breaks in the genome; and a change in nucleic acid or amino acid sequence. (Embodiment 75) The modified cell of embodiment 74, wherein the insertion includes or creates an upregulatory sequence. (Embodiment 76) The modified cell of embodiment 74, wherein the insertion includes or creates a down-regulatory sequence. (Embodiment 77) The modified cell of any of embodiments 69-74, wherein at least one the modifications knocks out expression of the modified gene. (Embodiment 78) The modified cell of any of embodiments 69-74, wherein at least one of the modifications improves mRNA translation efficiency. (Embodiment 79) The modified cell of any of embodiments 69-74, wherein at least one of the modifications results in diminished mRNA translation efficiency. (Embodiment 80) The modified cell of any of embodiments 69-74, wherein at least one of the modifications is an epigenetic modification. (Embodiment 81) The modified cell of any of embodiments 69-74, wherein at least one of the modifications includes the insertion or creation of at least one transcription factor binding site. (Embodiment 82) The modified cell of any of embodiments 69-74, wherein at least one of the modifications includes an insertion, and wherein the insertion is accompanied by the deletion of sequences from the genome of the cell. (Embodiment 83) The modified cell of any of embodiments 69-74, wherein at least one of the modifications includes an insertion, and wherein the insertion is in a region of the genome that is recalcitrant to meiotic or mitotic recombination. (Embodiment 84) The modified cell of any of embodiments 69-74, wherein at least one of the modifications is an introduced sequence selected from the following: a. a sequence encoding at least one stop codon, or at least one stop codon on each strand, or at least one stop codon within each reading frame on each strand; b. a heterologous primer sequence; c. a unique identifier sequence; d. a transcript-stabilizing sequence; e. a transcript-destabilizing sequence; f. a sequence encoding an RNA aptamer or an amino acid aptamer; and g. a sequence recognizable by a specific RNA or DNA binding agent. (Embodiment 85) The modified cell of embodiment 84 wherein at least one of the modifications is the introduction of a sequence recognizable by a specific binding agent, and wherein contacting the sequence with the specific binding agent results in a change of expression of a sequence of interest. (Embodiment 86) The modified cell of embodiment 85 wherein: (a) the sequence recognizable by a specific binding agent includes an auxin response element sequence, the specific binding agent is an auxin, and the change of expression is upregulation; (b) the sequence recognizable by a specific binding agent includes at least one D1-4 sequence, the specific binding agent is an auxin, and the change of expression is upregulation; (c) the sequence recognizable by a specific binding agent includes at least one DR5 sequence, the specific binding agent is an auxin, and the change of expression is upregulation; (d) the sequence recognizable by a specific binding agent includes at least one m5-DR5 sequence, the specific binding agent is an auxin, and the change of expression is upregulation; (e) the sequence recognizable by a specific binding agent includes at least one P3 sequence, the specific binding agent is an auxin, and the change of expression is upregulation; (f) the sequence recognizable by a specific binding agent includes a small RNA recognition site sequence, the specific binding agent is the corresponding small RNA, and the change of expression is downregulation; (g) the sequence recognizable by a specific binding agent includes a microRNA (miRNA) recognition site sequence, the specific binding agent is the corresponding mature miRNA, and the change of expression is downregulation; (h) the sequence recognizable by a specific binding agent includes a microRNA (miRNA) recognition site sequence for an engineered miRNA, the specific binding agent is the corresponding engineered mature miRNA, and the change of expression is downregulation; (i) the sequence recognizable by a specific binding agent includes a transposon recognition sequence, the specific binding agent is the corresponding transposon, and the change of expression is upregulation or downregulation; (j) the sequence recognizable by a specific binding agent includes an ethylene-responsive element binding-factor-associated amphiphilic repression (EAR) motif sequence, the specific binding agent is ERF (ethylene-responsive element binding factor) or co-repressor, and the change of expression is downregulation; (k) the sequence recognizable by a specific binding agent includes a splice site sequence, the specific binding agent is a spliceosome, and the change of expression is expression of a spliced transcript; (l) the sequence recognizable by a specific binding agent includes a site-specific recombinase recognition site sequence, the specific binding agent is the corresponding site-specific recombinase, and the change of expression is upregulation or downregulation or expression of a transcript having an altered sequence; (m) the sequence recognizable by a specific binding agent includes sequence encoding an RNA aptamer or an RNA riboswitch, the specific binding agent is the corresponding ligand, and the change in expression is upregulation or downregulation; (n) the sequence recognizable by a specific binding agent is a hormone responsive element, the specific binding agent is a hormone, and the change in expression is upregulation or downregulation; or (o) the sequence recognizable by a specific binding agent is a transcription factor binding sequence, the specific binding agent is the corresponding transcription factor, and the change in expression is upregulation or downregulation. (Embodiment 87) The modified cell of embodiment 86, wherein at least one modification includes the introduction of a nucleotide sequence that encodes an RNA molecule or an amino acid sequence that is recognizable by a specific binding agent. (Embodiment 88) The modified cell of embodiment 86, wherein at least one modification includes the introduction of a nucleotide sequence that encodes an RNA molecule or an amino acid sequence that binds specifically to a ligand. (Embodiment 89) The modified cell of embodiment 86, wherein the modified gene encodes at least one stop codon on each strand. (Embodiment 90) The modified cell of embodiment 86, wherein the modified gene encodes at least one stop codon within each reading frame on each strand. (Embodiment 91) The modified cell of embodiment 86, wherein the modified gene encodes a transcript that is capable of forming at least partially double-stranded RNA. (Embodiment 92) The modified cell of embodiment 86, wherein the modified gene includes a nucleotide sequence that is responsive to a specific change in the physical environment, and wherein exposing the integrated polynucleotide molecule to the specific change in the physical environment results in a change of expression of a sequence of interest. (Embodiment 93) The modified cell of embodiment 92, wherein the specific change in the physical environment is at least one of: a change in light intensity or quality, a change in temperature, a change in pressure, a change in osmotic concentration, or a change in day length. (Embodiment 94) The modified cell of embodiment 93, wherein the modified gene encodes a Light-Oxygen-Voltage domain (Embodiment 95) The modified cell of any of embodiments 69-94, wherein the modified cell includes an inserted regulatory sequence selected from the sequences listed in Table 24. (Embodiment 96) The modified cell of any of embodiments 69-95, wherein the modified *Zea* sp. cell is an isolated cell or protoplast. (Embodiment 97) The modified cell of any of embodiments 69-95, wherein the modified *Zea* sp. cell is in a *Zea* sp. plant, or in a zygotic or somatic embryo, seed, part, or tissue of a *Zea* sp. plant. (Embodiment 98) The modified cell of any of embodiments 69-95, wherein the modified *Zea* sp. cell is capable of division or differentiation. (Embodiment 99) The modified cell of any of embodiments 69-95, wherein the modified *Zea* sp. cell is haploid, diploid, or polyploid. (Embodiment 100) The modified cell of any of embodiments 69-95, wherein the modified *Zea* sp. cell is a meristematic cell, embryonic cell, or germline cell. (Embodiment 101) The modified cell of any of embodiments 69-100, wherein the modifications are determined relative to a parent plant cell, and wherein the modified plant cell is devoid of mitotically or meiotically generated genetic or epigenetic changes relative to the parent plant cell. (Embodiment 102) A method of modifying a *Zea* sp. cell by creating a plurality of targeted modifications in the genome of the cell, including: contacting the genome with one or more targeting agents, wherein the one or more agents include or encode predetermined peptide or nucleic acid sequences, wherein the predetermined peptide or nucleic acid sequences bind preferentially at or near predetermined target sites within the plant genome, and wherein the binding facilitates the generation of the plurality of targeted modifications within the genome; wherein the plurality of targeted modifications occurs without an intervening step of separately identifying an individual modification and without a step of separately selecting for the occurrence of an individual modification among the plurality of targeted modifications mediated by the targeting agents; and wherein the targeted modifications alter at least one trait of the plant cell, or at least one trait of a plant including the plant cell, or at least one trait of a plant grown from the plant cell, or result in a detectable phenotype in the modified plant cell; and wherein at least two of the targeted modifications are insertions of predetermined sequences encoded by one or more polynucleotide donor molecules, and wherein at least one of the polynucleotide donor molecules lacks homology to the genome sequences adjacent to the site of insertion; and wherein at least one of the targeted modifications is directed to a gene listed in Table 23. (Embodiment 103) The method of embodiment 102, wherein at least one of the polynucleotide donor molecules is a single stranded DNA molecule, a single stranded RNA molecule, a single stranded DNA-RNA hybrid molecule, or a duplex RNA-DNA molecule. (Embodiment 104) The method of embodiment 102 or 103, wherein the modified plant cell is a meristematic cell, embryonic cell, or germline cell. (Embodiment 105) The method of any of embodiments 102, 103 or 104, wherein repetition of the method results in an efficiency of at least 1%, wherein said efficiency is determined by dividing the number of successfully targeted cells by the total number of cells targeted. (Embodiment 106) A method of modifying a *Zea* sp. cell by creating a plurality of targeted modifications in the genome of the cell, including: contacting the genome with one or more targeting agents, wherein the one or more agents include or encode predetermined peptide or nucleic acid sequences, wherein the predetermined peptide or nucleic acid sequences bind preferentially at or near predetermined target sites within the plant genome, and wherein the binding facilitates the generation of the plurality of targeted modifications within the genome; wherein the plurality of targeted modifications occurs without an intervening step of separately identifying an individual modification and without a step of separately selecting for the occurrence of an individual modification among the plurality of targeted modifications mediated by the targeting agents; wherein the targeted modifications improve at least one trait of the plant cell, or at least one trait of a plant including the plant cell, or at least one trait of a plant grown from the plant cell, or result in a detectable phenotype in the modified plant cell; and wherein at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule and wherein at least one of the targeted modifications is directed to a gene listed in Table 23. (Embodiment 107) The method of embodiment 106, wherein at least one of the polynucleotide donor molecules lacks homology to the genome sequences adjacent to the site of insertion. (Embodiment 108) The method of embodiments 106 or 107, wherein the modified plant cell is a meristematic cell, embryonic cell, or germline cell. (Embodiment 109) The method of any of embodiments 106, 107, or 108, wherein repetition of the method results in an efficiency of at least 1%, wherein said efficiency is determined by dividing the number of successfully targeted cells by the total number of cells targeted. (Embodiment 110) A method of modifying a *Zea* sp. cell by creating a plurality of targeted modifications in the genome of the plant cell, including: contacting the genome with one or more targeting agents, wherein the one or more agents include or encode predetermined peptide or nucleic acid sequences, wherein the predetermined peptide or nucleic acid sequences bind preferentially at or near predetermined target sites within the plant genome, and wherein the binding facilitates the generation of the plurality of targeted modifications within the genome; wherein the plurality of modifications occurs without an intervening step of separately identifying an individual modification and without a step of separately selecting for the occurrence of an individual modification among the plurality of targeted modifications mediated by the targeting agents; and wherein the targeted modifications improve at least one trait of the plant cell, or at least one trait of a plant including the plant cell, or at least one trait of a plant or seed obtained from the plant cell, or result in a detectable phenotype in the modified plant cell; and wherein the modified plant cell is a meristematic cell, embryonic cell, or germline cell; and wherein at least one of the targeted modifications is directed to a gene listed in Table 23. (Embodiment 111) The method of embodiment 110, wherein at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. (Embodiment 112) The method of embodiment 110 or 111, wherein at least one of the polynucleotide donor molecules lacks homology to the genome sequences adjacent to the site of insertion. (Embodiment 113) The method of any of embodiments 110, 111, or 112, wherein repetition of the method results in an efficiency of at least 1%, wherein said efficiency is determined by dividing the number of successfully targeted cells by the total number of cells targeted. (Embodiment 114) A method of modifying a *Zea* sp. cell by creating a plurality of targeted modifications in the genome of the cell, including: contacting the genome with one or more targeting agents, wherein the one or more agents include or encode predetermined peptide or nucleic acid sequences, wherein the predetermined peptide or nucleic acid sequences bind preferentially at or near predetermined target sites within the plant genome, and wherein the binding facilitates the generation of the plurality of targeted modifications within the genome; wherein the plurality of modifications occurs without an intervening step of separately identifying an individual modification and without a step of separately selecting for the occurrence of an individual modification among the plurality of targeted modifications mediated by the targeting agents; and wherein the targeted modifications improve at least one trait of the plant cell, or at least one trait of a plant including the plant cell, or at least one trait of a plant or seed obtained from the plant cell, or result in a detectable phenotype in the modified plant cell; and wherein repetition of the aforementioned steps results in an efficiency of at least 1%, wherein said efficiency is determined by dividing the number of successfully targeted cells by the total number of cells targeted; and wherein at least one of the targeted modifications is directed to a gene listed in Table 23. (Embodiment 115) The method of embodiment 114, wherein the modified plant cell is a meristematic cell, embryonic cell, or germline cell. (Embodiment 116) The method of embodiment 114 or 115, wherein at least one of the targeted modifications is an insertion of a predetermined sequence encoded by one or more polynucleotide donor molecules, and wherein at least one of the polynucleotide donor molecules is a single stranded DNA molecule, a single stranded RNA molecule, a single stranded DNA-RNA hybrid molecule, or a duplex RNA-DNA molecule. (Embodiment 117) The method of any of embodiments 114, 115, or 116, wherein at least one of the polynucleotide donor molecules lacks homology to the genome sequences adjacent to the site of insertion. (Embodiment 118) The method of any of embodiments 102-117, wherein at least one of the targeted modifications is an insertion between 3 and 400 nucleotides in length, between 10 and 350 nucleotides in length, between 18 and 350 nucleotides in length, between 18 and 200 nucleotides in length, between 10 and 150 nucleotides in length, or between 11 and 100 nucleotides in length. (Embodiment 119) The method of embodiment 118, wherein two of the targeted modifications are insertions between 10 and 350 nucleotides in length, between 18 and 350 nucleotides in length, between 18 and 200 nucleotides in length, between 10 and 150 nucleotides in length, or between 11 and 100 nucleotides in length. (Embodiment 120) The method of any of embodiments 102-119, including at least two insertions, wherein at least one of the insertions is an upregulatory sequence. (Embodiment 121) The method of any of embodiments 102-119 wherein at least one of the insertions is a regulatory sequence listed in Table 24. (Embodiment 122) The method of any of embodiments 102-119, including the insertion or creation of at least one transcription factor binding site. (Embodiment 123) The method of any of embodiments 102-122, including the insertion or insertions of predetermined sequences, wherein the insertion or insertions of predetermined sequences are accompanied by the deletion of sequences from the plant genome. (Embodiment 124) The method of any of embodiments 102-123 further including obtaining a plant from the modified plant cell and breeding the plant. (Embodiment 125) The method of any of embodiments 102-123, further including a step of introducing additional genetic or epigenetic changes into the modified plant cell or into a plant grown from the modified plant cell. (Embodiment 126) The method of any of embodiments 102-125, including introducing at least two targeted insertions, wherein at least two of the targeted insertions independently up- or down-regulate the expression of two or more distinct genes. (Embodiment 127) The method of any of embodiments 102-126, wherein the donor polynucleotide is tethered to a crRNA by a covalent bond, a non-covalent bond, or a combination of covalent and non-covalent bonds. (Embodiment 128) The method of any of embodiments 102-127, wherein a loss of epigenetic marks after modification occurs in less than 0.01% of the genome. (Embodiment 129) The method of any of embodiments 102-127, wherein the genome of the modified plant cell is more than 99.9% identical to the genome of the parent cell. (Embodiment 130) The method of any of embodiments 102-129, wherein at least one of the targeted modifications is an insertion, and wherein at least one insertion is in a region of the genome that is recalcitrant to meiotic or mitotic recombination. (Embodiment 131) The method of any of embodiments 102-130, wherein the cell is a member of a pool of cells being targeted, and wherein the modified cells within the pool are characterized by sequencing after targeting. (Embodiment 132) The method of any of embodiments 102-131, wherein at least one DSB is introduced into the genome by at least one of the group consisting of: (a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, a meganuclease, an engineered meganuclease, a recombinase, integrase, and a transposase; (b) a polynucleotide encoding one or more nucleases capable of effecting site-specific alteration of a target nucleotide sequence; and (c) a guide RNA (gRNA) for an RNA-guided nuclease, and a DNA encoding a gRNA for an RNA-guided nuclease. (Embodiment 133) The method of any of embodiments 102-131, wherein at least one DSB is introduced into the genome by at least one at least one treatment selected from the group consisting of: (a) bacterially mediated (e.g., *Agrobacterium* sp., *Rhizobium* sp., *Sinorhizobium* sp., *Mesorhizobium* sp., *Bradyrhizobium* sp., *Azobacter* sp., *Phyllobacterium* sp.) transfection; (b) Biolistics or particle bombardment; (c) treatment with at least one chemical, enzymatic, or physical agent; and (d) application of heat or cold, ultrasonication, centrifugation, positive or negative pressure, cell wall or membrane disruption or deformation, or electroporation. (Embodiment 134) The method of any of embodiments 102-133, wherein at least one DSB is introduced in the genome: (a) within a sequence of interest, (b) upstream of a sequence of interest, or (c) downstream of a sequence of interest. (Embodiment 135) The method of embodiment 134, wherein a polynucleotide molecule, when integrated into the genome, is functionally or operably linked to the sequence of interest. (Embodiment 136) The method of embodiment 135, wherein the sequence of interest includes coding sequence, non-coding sequence, or a combination of coding and non-coding sequence. (Embodiment 137) The method of embodiment 134, wherein the at least one DSB is two or more DSBs. (Embodiment 138) The method of embodiment 137, wherein the polynucleotide molecule that is integrated into each of the two or more DSBs is (a) identical, or (b) different, for each of the DSBs. (Embodiment 139) The method of 135, wherein the polynucleotide molecule includes at least one of the nucleotide sequences selected from the group consisting of: (a) DNA or RNA encoding at least one stop codon, or at least one stop codon on each strand, or at least one stop codon within each reading frame on each strand; (b) DNA or RNA encoding heterologous primer sequence; (c) DNA or RNA encoding a unique identifier sequence; (d) DNA or RNA encoding a transcript-stabilizing sequence; (e) DNA or RNA encoding a transcript-destabilizing sequence; (f) a DNA or RNA aptamer, or DNA encoding an RNA aptamer, or DNA or RNA encoding an amino acid aptamer; and (g) DNA or RNA encoding a sequence recognizable by a specific binding agent. (Embodiment 140) The method of embodiment 135 wherein the polynucleotide molecule includes DNA or RNA encoding a sequence recognizable by a specific binding agent, and wherein contacting the integrated polynucleotide molecule with the specific binding agent results in a change of expression of the sequence of interest. (Embodiment 141) The method of embodiment 140 wherein: (a) the sequence recognizable by a specific binding agent includes an auxin response element sequence, the specific binding agent is an auxin, and the change of expression is upregulation; (b) the sequence recognizable by a specific binding agent includes at least one D1-4 sequence, the specific binding agent is an auxin, and the change of expression is upregulation; (c) the sequence recognizable by a specific binding agent includes at least one DR5 sequence, the specific binding agent is an auxin, and the change of expression is upregulation; (d) the sequence recognizable by a specific binding agent includes at least one m5-DR5 sequence, the specific binding agent is an auxin, and the change of expression is upregulation; (e) the sequence recognizable by a specific binding agent includes at least one P3 sequence, the specific binding agent is an auxin, and the change of expression is upregulation; (f) the sequence recognizable by a specific binding agent includes a small RNA recognition site sequence, the specific binding agent is the corresponding small RNA, and the change of expression is downregulation; (g) the sequence recognizable by a specific binding agent includes a microRNA (miRNA) recognition site sequence, the specific binding agent is the corresponding mature miRNA, and the change of expression is downregulation; (h) the sequence recognizable by a specific binding agent includes a microRNA (miRNA) recognition site sequence for an engineered miRNA, the specific binding agent is the corresponding engineered mature miRNA, and the change of expression is downregulation; (i) the sequence recognizable by a specific binding agent includes a transposon recognition sequence, the specific binding agent is the corresponding transposon, and the change of expression is upregulation or downregulation; (j) the sequence recognizable by a specific binding agent includes an ethylene-responsive element binding-factor-associated amphiphilic repression (EAR) motif sequence, the specific binding agent is ERF (ethylene-responsive element binding factor) or co-repressor, and the change of expression is downregulation; (k) the sequence recognizable by a specific binding agent includes a splice site sequence, the specific binding agent is a spliceosome, and the change of expression is expression of a spliced transcript; (l) the sequence recognizable by a specific binding agent includes a site-specific recombinase recognition site sequence, the specific binding agent is the corresponding site-specific recombinase, and the change of expression is upregulation or downregulation or expression of a transcript having an altered sequence; (m) the sequence recognizable by a specific binding agent includes sequence encoding an RNA aptamer or an RNA riboswitch, the specific binding agent is the corresponding ligand, and the change in expression is upregulation or downregulation; (n) the sequence recognizable by a specific binding agent is a hormone responsive element, the specific binding agent is a hormone, and the change in expression is upregulation or downregulation; or (o) the sequence recognizable by a specific binding agent is a transcription factor binding sequence, the specific binding agent is the corresponding transcription factor, and the change in expression is upregulation or downregulation. (Embodiment 142) The method of embodiment 140 wherein the polynucleotide molecule includes a nucleotide sequence that encodes an RNA molecule or an amino acid sequence that is recognizable by a specific binding agent. (Embodiment 143) The method of embodiment 140, wherein the polynucleotide molecule includes a nucleotide sequence that encodes an RNA molecule or an amino acid sequence that binds specifically to a ligand. (Embodiment 144) The method of embodiment 139, wherein the polynucleotide molecule encodes at least one stop codon on each strand. (Embodiment 145) The method of embodiment 139, wherein the polynucleotide molecule encodes at least one stop codon within each reading frame on each strand. (Embodiment 146) The method of embodiment 139, wherein the polynucleotide molecule includes at least partially self-complementary sequence, such that the polynucleotide molecule encodes a transcript that is capable of forming at least partially double-stranded RNA. (Embodiment 147) The method of embodiment 139 wherein the polynucleotide molecule includes a nucleotide sequence that is responsive to a specific change in the physical environment, and wherein exposing the integrated polynucleotide molecule to the specific change in the physical environment results in a change of expression of the sequence of interest. (Embodiment 148) The method of embodiment 147, wherein the specific change in the physical environment is at least one of: a change in light intensity or quality, a change in temperature, a change in pressure, a change in osmotic concentration, or a change in day length. (Embodiment 149) The method of embodiment 139, wherein the polynucleotide molecule includes a nucleotide sequence encoding an RNA molecule or an amino acid sequence that is responsive to a specific change in the physical environment. (Embodiment 150) The method of embodiment 149, wherein the polynucleotide molecule encodes a Light-Oxygen-Voltage domain. (Embodiment 151) The method of embodiment 132, wherein each gRNA is provided as a polynucleotide composition including: (a) a CRISPR RNA (crRNA) that includes the gRNA, or a polynucleotide that encodes a crRNA, or a polynucleotide that is processed into a crRNA; or (b) a single guide RNA (sgRNA) that includes the gRNA, or a polynucleotide that encodes a sgRNA, or a polynucleotide that is processed into a sgRNA. (Embodiment 152) The method of embodiment 151, wherein each gRNA is provided as a ribonucleoprotein (RNP) including the RNA-guided nuclease and an sgRNA. (Embodiment 153) The method of embodiment 134, wherein: (a) the at least one DSB is two blunt-ended DSBs, resulting in deletion of genomic sequence between the two blunt-ended DSBs, and wherein the polynucleotide molecule is selected from the group consisting of a blunt-ended double-stranded DNA, a single-stranded DNA, a single-stranded DNA/RNA hybrid, and a blunt-ended double-stranded DNA/RNA hybrid and is integrated into the genome between the two blunt-ended DSBs; (b) the at least one DSB is two DSBs, wherein the first DSB is blunt-ended and the second DSB has an overhang, resulting in deletion of genomic sequence between the two DSBs, and wherein the polynucleotide molecule is a double-stranded DNA or double-stranded DNA/RNA hybrid that is blunt-ended at one terminus and has an overhang on the other terminus, or is a single-stranded DNA or a single-stranded DNA/RNA hybrid, and is integrated into the genome between the two DSBs; wherein the at least one DSB is two DSBs, each having an overhang, resulting in deletion of genomic sequence between the two DSBs, and wherein the polynucleotide molecule is a double-stranded DNA or double-stranded DNA/RNA hybrid that has an overhang at each terminus or is a single-stranded DNA or a single-stranded DNA/RNA hybrid, and is integrated into the genome between the two DSBs. (Embodiment 154) A modified *Zea* sp. cell resulting from the method of any embodiments 102-153. (Embodiment 155) A modified *Zea* sp. plant grown from a modified plant cell of embodiment 154. (Embodiment 156) The modified *Zea* sp. cell of embodiment 16, wherein the modified plant cell includes at least two precise and separately targeted insertions in its genome, wherein the insertions are determined relative to a parent plant cell, and wherein the modified plant cell is devoid of mitotically or meiotically generated genetic or epigenetic changes relative to the parent plant cell. (Embodiment 157) A modified *Zea* sp. cell, wherein the modified plant cell includes at least two precise and separately targeted insertions in its genome, wherein the insertions are determined relative to a parent plant cell, and wherein the modified plant cell is devoid of mitotically or meiotically generated genetic or epigenetic changes relative to the parent plant cell, and wherein at least one of the insertions regulates the expression of a gene listed in Table 23. (Embodiment 158) A modified *Zea* sp. cell, wherein the modified plant cell includes at least two precise and separately targeted insertions in its genome, wherein the insertions are determined relative to a parent plant cell, and wherein at least one of the insertions regulates the expression of a gene or protein listed in Table 23, and wherein the genome of the modified plant cell is at least 95%, at least 96%, at least 97%, at least 98%, at least 99%, at least 99.5%, at least 99.9%, or at least 99.99% identical to the parent cell. (Embodiment 159) A modified *Zea* sp. cell, wherein the modified plant cell includes at least two precise and separately targeted modifications to its genome, wherein the modifications are determined relative to a parent plant cell, and wherein at least one of the modifications regulates the expression of a gene or protein listed in Table 23, and wherein the genome of the modified plant cell is at least 95%, at least 96%, at least 97%, at least 98%, at least 99%, at least 99.5%, at least 99.9%, or at least 99.99% identical to the parent cell. (Embodiment 160) The modified Zea sp. cell of any of embodiments 157-159, wherein at least one modification is the insertion or creation of a regulatory sequence listed in Table 24. (Embodiment 161) A method of manufacturing a processed Zea sp. product, including: (a) modifying a Zea sp. cell according to the method of any one of the preceding embodiments, (b) growing a modified Zea sp. plant from the cell, and (c) processing the modified Zea sp. plant into a processed product, thereby manufacturing a processed Zea sp. plant product. (Embodiment 162) The method of embodiment 161, wherein the processed product is meal, oil, juice, sugar, starch, fiber, an extract, wood or wood pulp, flour, or cloth. (Embodiment 163) The method of embodiment 161 or 162, further including packaging said product. (Embodiment 164) A method of manufacturing a Zea sp. plant product, including: (a) modifying a Zea sp plant cell according to the method of any one of embodiments 102-153, (b) growing a modified Zea sp plant from said plant cell, (c) harvesting a product of the modified plant, thereby manufacturing a plant product. (Embodiment 165) The method of embodiment 164, wherein the plant product is a product selected from the group consisting of leaves, vegetables, nuts, seeds, oil, flowers, fodder, silage, stover, and pollen. (Embodiment 166) The method of embodiment 164 or 165, further including packaging said plant product. (Embodiment 167) The method of any of embodiments 102-153 including the use of a donor polynucleotide, gRNA or crRNA described in the Examples herein. (Embodiment 168) A method of changing expression of a sequence of interest in a Zea sp. genome, including integrating a sequence encoded by a polynucleotide donor molecule at the site of at least one double-strand break (DSB) in a genome, wherein the polynucleotide donor molecule is selected from the group consisting of a double-stranded DNA, a single-stranded DNA, a single-stranded DNA/RNA hybrid, and a double-stranded DNA/RNA hybrid. (Embodiment 169) The method of embodiment 168, wherein the genome is that of a nucleus, mitochondrion, or plastid in a Zea sp. cell. (Embodiment 170) The method of embodiment 168, wherein the at least one DSB is introduced into the Zea sp. genome by at least one of the group consisting of: (a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease; (b) a polynucleotide encoding one or more nucleases capable of effecting site-specific alteration of a target nucleotide sequence; and (c) a guide RNA (gRNA) for an RNA-guided nuclease, or a DNA encoding a gRNA for an RNA-guided nuclease. (Embodiment 171) The method of embodiment 168, wherein the at least one DSB is introduced into the Zea sp. genome by at least one treatment selected from the group consisting of: (a) bacterially mediated (e.g., Agrobacterium sp., Rhizobium sp., Sinorhizobium sp., Mesorhizobium sp., Bradyrhizobium sp., Azobacter sp., Phyllobacterium sp.) transfection; (b) Biolistics or particle bombardment; (c) treatment with at least one chemical, enzymatic, or physical agent; and (d) application of heat or cold, ultrasonication, centrifugation, positive or negative pressure, cell wall or membrane disruption or deformation, or electroporation. (Embodiment 172) The method of embodiment 168, wherein the at least one DSB in a genome is located: (a) within the sequence of interest, (b) upstream of the sequence of interest, or (c) downstream of the sequence of interest, and wherein the sequence of interest is a gene listed in Table 23. (Embodiment 173) The method of embodiment 168, wherein the sequence encoded by the polynucleotide donor molecule, when integrated into the genome, is functionally or operably linked to the sequence of interest. (Embodiment 174) The method of embodiment 168, wherein the sequence of interest includes coding sequence, non-coding sequence, or a combination of coding and non-coding sequence. (Embodiment 175) The method of embodiment 168, wherein the at least one DSB is two or more DSBs. (Embodiment 176) The method of embodiment 168, wherein the sequence encoded by the polynucleotide donor molecule that is integrated into each of the two or more DSBs is (a) identical, or (b) different, for each of the DSBs. (Embodiment 177) The method of embodiment 168, wherein the sequence encoded by the polynucleotide donor molecule includes at least one of the nucleotide sequences selected from the group consisting of: (a) DNA or RNA encoding at least one stop codon, or at least one stop codon on each strand, or at least one stop codon within each reading frame on each strand; (b) DNA or RNA encoding heterologous primer sequence; (c) DNA or RNA encoding a unique identifier sequence; (d) DNA or RNA encoding a transcript-stabilizing sequence; (e) DNA or RNA encoding a transcript-destabilizing sequence; (f) a DNA or RNA aptamer, or DNA encoding an RNA aptamer, or DNA or RNA encoding an amino acid aptamer; and (g) DNA or RNA encoding a sequence recognizable by a specific binding agent (h) a regulatory sequence listed in Table 24. (Embodiment 178) The method of embodiment 168, wherein the sequence encoded by the polynucleotide donor molecule includes DNA or RNA encoding a sequence recognizable by a specific binding agent, and wherein contacting the integrated sequence encoded by the polynucleotide donor molecule with the specific binding agent results in a change of expression of the sequence of interest. (Embodiment 179) A Zea sp. plant cell including in its genome a heterologous DNA sequence that includes: (a) a nucleotide sequence of a polynucleotide donor molecule integrated by the method of embodiment 168 at the site of a DSB in a genome; and (b) genomic nucleotide sequence adjacent to the site of the DSB; and (c) wherein the integrated sequence is selected from the regulatory sequences listed in Table 24. (Embodiment 180) A Zea sp. cell of embodiment 179, wherein the gene or protein whose expression is regulated by the integrated regulatory sequence is listed in Table 23. (Embodiment 181) A Zea sp. plant including the modified cell of embodiments 179 or 180. (Embodiment 182) The modified cell of embodiment 1, wherein the targeted modification is a deletion of an miRNA recognition site with the sequence of SEQ ID NO:999 in a 5' UTR region of an SPX domain containing gene, wherein the targeted modification results in increased nitrogen use efficiency. (Embodiment 183) The modified cell of embodiment 1, wherein the targeted modification is a deletion or demethylation of a miniature inverted-repeat transposable element (MITE) sequence in a promoter region of NAC111 gene, wherein the targeted modification results in increased water use efficiency and enhanced drought tolerance. (Embodiment 184) The modified cell of embodiment 1, wherein the targeted modification is a nucleotide sequence substitution of a coding region of PYL-E gene, resulting an E149L mutation in PYL-E protein, wherein the targeted modification results in a PYL-E allele with hypersensitivity to ABA receptor and increased water use efficiency. (Embodiment 185) The modified cell of embodiment 1, wherein the targeted modification is an insertion of a promoter sequence of GA2-oxidase in a promoter region of PLA1 gene, wherein the targeted modification results in increased biomass and seed yield. (Embodiment 186) The modified cell of embodiment 36, wherein the modified cell includes at least three targeted modifications, wherein the targeted modifications are an insertion of a nitrogen responsive element in NRT2.2; an insertion of a nitrogen responsive element in GLN1.4; and an insertion of an OCS homologue in Dof1, wherein the targeted modifications result in increased nitrogen use efficiency. (Embodiment 187) The modified cell of embodiment 36, wherein the modified cell includes four targeted modifications, wherein the targeted modifications are an insertion of a nitrogen responsive element in NRT2.2; an insertion of a nitrogen responsive element in GLN1.4 gene; an insertion of an OCS homologue in Dof1; and a deletion of an miRNA recognition site in a 5' UTR region of an SPX domain containing gene, wherein the targeted modifications result in increased nitrogen use efficiency. (Embodiment 188) The modified cell of embodiment 69, wherein the modified cell includes two targeted modifications, wherein the targeted modifications are a deletion or demethylation of a miniature inverted-repeat transposable element (MITE) sequence in a promoter region of NAC111 and an insertion of a promoter sequence of GA2-oxidase in a promoter region of PLA1, wherein the targeted modifications result in increased water use efficiency and enhanced drought tolerance together with increased biomass and seed yield. (Embodiment 189) The modified cell of embodiment 69, wherein the modified cell includes four targeted modifications, wherein the first modification is an insertion of a nitrogen responsive element NRT2.2, an insertion of a nitrogen responsive element in GLN1.4, an insertion of an OCS homologue in Dof1, or a deletion of an miRNA recognition site in a 5' UTR region of an SPX domain containing gene GRMZM2G086430; and wherein the second modification is an insertion of a promoter sequence of GA2-oxidase in a promoter region of PLA1; the third modification is a nucleotide sequence substitution of a coding region of PYL-E gene, resulting an E149L mutation in PYL-E protein; and the fourth modification is a deletion or demethylation of a miniature inverted-repeat transposable element (MITE) sequence in a promoter region of NAC111, wherein the targeted modifications result in increased nitrogen use efficiency, increased biomass and seed yield, hypersensitivity to ABA receptor, and increased water use efficiency. (Embodiment 190) A modified *Zea* sp. plant derived from the modified cell of any of embodiments 182-189.

EXAMPLES

Example 1

This example illustrates techniques for preparing a plant cell or plant protoplast useful in compositions and methods of the invention, for example, in providing a reaction mixture including a plant cell having a double-strand break (DSB) at at least one locus in its genome. More specifically this non-limiting example describes techniques for preparing isolated, viable plant protoplasts from monocot plants.

The following mesophyll protoplast preparation protocol (modified from one publicly available at molbio[dot]mgh [dot]harvard.edu/sheenweb/protocols_reg[dot]html) is generally suitable for use with monocot plants such as maize (*Zea mays*):

Prepare an enzyme solution containing 0.6 molar mannitol, 10 millimolar MES pH 5.7, 1.5% cellulase R10, and 0.3% macerozyme R10. Heat the enzyme solution at 50-55 degrees Celsius for 10 minutes to inactivate proteases and accelerate enzyme solution and cool it to room temperature before adding 1 millimolar $CaCl_2$, 5 millimolar β-mercaptoethanol, and 0.1% bovine serum albumin. Pass the enzyme solution through a 0.45 micrometer filter. Prepare a washing solution containing 0.6 molar mannitol, 4 millimolar MES pH 5.7, and 20 millimolar KCl.

Obtain second leaves of the monocot plant (e. g., maize) and cut out the middle 6-8 centimeters. Stack ten leaf sections and cut into 0.5 millimeter-wide strips without bruising the leaves. Submerge the leaf strips completely in the enzyme solution in a petri dish, cover with aluminum foil, and apply vacuum for 30 minutes to infiltrate the leaf tissue. Transfer the dish to a platform shaker and incubate for an additional 2.5 hours' digestion with gentle shaking (40 rpm). After digestion, carefully transfer the enzyme solution (now containing protoplasts) using a serological pipette through a 35 micrometer nylon mesh into a round-bottom tube; rinse the petri with 5 milliliters of washing solution and filter this through the mesh as well. Centrifuge the protoplast suspension at 1200 rpm, 2 minutes in a swing-bucket centrifuge. Aspirate off as much of the supernatant as possible without touching the pellet; gently wash the pellet once with 20 milliliters washing buffer and remove the supernatant carefully. Gently resuspend the pellet by swirling in a small volume of washing solution, then resuspend in 10-20 milliliters of washing buffer. Place the tube upright on ice for 30 minutes-4 hours (no longer). After resting on ice, remove the supernatant by aspiration and resuspend the pellet with 2-5 milliliters of washing buffer. Measure the concentration of protoplasts using a hemocytometer and adjust the concentration to $2 \times 10^5$ protoplasts/milliliter with washing buffer.

Example 2

This example illustrates a method of delivery of an effector molecule to a plant cell or plant protoplast to effect a genetic change, in this case introduction of a double-strand break in the genome. More specifically, this non-limiting example describes a method of delivering a guide RNA (gRNA) in the form of a ribonucleoprotein (RNP) to isolated plant protoplasts.

The following delivery protocol (modified from one publicly available at molbio[dot]mgh[dot]harvard.edu/sheenweb/protocols_reg[dot]html) is generally suitable for use with monocot plants such as maize (*Zea mays*):

Prepare a polyethylene glycol (PEG) solution containing 40% PEG 4000, 0.2 molar mannitol, and 0.1 molar $CaCl_2$. Prepare an incubation solution containing 170 milligram/liter $KH_2PO_4$, 440 milligram/liter $CaCl_2.2H_2O$, 505 milligram/liter $KNO_3$, 160 milligram/liter $NH_4NO_3$, 370 milligram/liter $MgSO_4.7H_2O$, 0.01 milligram/liter KI, 1 milligram/liter $H_3BO_3$, 0.1 milligram/liter $MnSO_4.4H_2O$, 1 milligram/liter $ZnSO_4.7H_2O$, 0.03 milligram/liter $CuSO_4.5H_2O$, 1 milligram/liter nicotinic acid, 1 milligram/liter thiamine HCl, 1 milligram/liter pyridoxine HCl, 0.2 milligram/liter folic acid, 0.01 milligram/liter biotin, 1 milligram/liter D-Ca-pantothenate, 100 milligram/liter myo-inositol, 40 grams/liter glucose, 60 grams/liter mannitol, 700 milligram/liter MES, 10 microliter/liter Tween 80, 1 milligram/liter 2,4-D, and 1 milligram/liter 6-benzylaminopurine (BAP); adjust pH to 5.6.

Prepare a crRNA:tracrRNA or guide RNA (gRNA) complex by mixing equal amounts of CRISPR crRNA and tracrRNA (obtainable e. g., as custom-synthesized Alt-R™ CRISPR crRNA and tracrRNA oligonucleotides from Integrated DNA Technologies, Coralville, Iowa): mix 6 microliters of 100 micromolar crRNA and 6 microliters of 100 micromolar tracrRNA, heat at 95 degrees Celsius for 5 minutes, and then cool the crRNA:tracrRNA complex to room temperature. To the cooled gRNA solution, add 10 micrograms Cas9 nuclease (Aldevron, Fargo, N. Dak.) and incubate 5 minutes at room temperature to allow the ribonucleoprotein (RNP) complex to form. Add the RNP solution to 100 microliters of monocot protoplasts (prepared as described in Example 1) in a microfuge tube; add 5 micrograms salmon sperm DNA (VWR Cat. No.: 95037-160) and an equal volume of the PEG solution. Mix gently by tapping. After 5 minutes, dilute with 880 microliters of washing buffer and mix gently by inverting the tube. Centrifuge 1 minute at 1200 rpm and then remove the supernatant. Resuspend the protoplasts in 1 milliliter incubation solution and transfer to a multi-well plate. The efficiency of genome editing is assessed by any suitable method such as heteroduplex cleavage assay or by sequencing, as described elsewhere in this disclosure.

The above protocols for delivery of gRNAs as RNPs to plant protoplasts are adapted for delivery of guide RNAs alone to monocot protoplasts that express Cas9 nuclease by transient or stable transformation; in this case, the guide RNA complex is prepared as before and added to the protoplasts, but no Cas9 nuclease and no salmon sperm DNA is added. The remainder of the procedures are identical.

Example 3

This example illustrates genome editing in monocot plants and further illustrates a method of identifying a nucleotide sequence associated with a phenotype of interest. More specifically, this non-limiting example describes delivering a guide RNA (gRNA) in the form of a ribonucleoprotein (RNP) to isolated plant protoplasts, followed by screening to identify the protoplasts in which the target nucleotide sequence has been altered by introduction of a double-stranded break (DSB).

The target gene selected for editing was the maize (*Zea mays*) alcohol dehydrogenase ADH1 (see www[dot]maizegdb[dot]org/gene_center/gene/GRMZM2G442658) with the partial genomic sequence:

```
                                              (SEQ ID NO: 21)
GAACAGTGCCGCAGTGGCGCTGATCTTGTATGCTATCCTGCAATCGTGG

TGAACTTATTTCTTTTATATCCTTTACTCCCATGAAAAGGCTAGTAATC

TTTCTCGATGTAACATCGTCCAGCACTGCTATTACCGTGTGGTCCATCC

GACAGTCTGGCTGAACACATCATACGATCTATGGAGCAAAAATCTATCT

TCCCTGTTCTTTAATGAAGGACGTCATTTTCATTAGTATGATCTAGGAA

TGTTGCAACTTGCAAGGAGGCGTTTCTTTCTTTGAATTTAACTAACTCG

TTGAGTGGCCCTGTTTCTCGGACGTAAGGCCTTTGCTGCTCCACACATG

TCCATTCGAATTTTACCGTGTTTAGCAAGGGCGAAAAGTTTGCATCTTG
```

```
ATGATTTAGCTTGACTATGCGATTGCTTTCCTGGACCCGTGCAGCTGCG

GTGGCATGGGAGGCCGGCAAGCCACTGTCGATCGAGGAGGTGGAGGTAG

CGCCTCCGCAGGCCATGGAGGTGCGCGTCAAGATCCTCTTCACCTCGCT

CTGCCACACCGACGTCTACTTCTGGGAGGCCAAGGTATCTAATCAGCCA

TCCCATTTGTGATCTTTGTCAGTAGATATGATACAACAACTCGCGGTTG

ACTTGCGCCTTCTTGGCGGCTTATCTGTCTTAGGGGCAGACTCCCGTGT

TCCCTCGGATCTTTGGCCACGAGGCTGGAGGGTA;
``` the first exon (SEQ ID NO:22), located at nucleotide positions 409-571 of SEQ ID NO:21 is indicated by bold, underlined text and guide RNA (crRNA) sequences were designed to edit this exon.

Maize protoplasts were prepared as described in Example 1. A ribonucleoprotein (RNP) was prepared with Cas9 nuclease (Aldevron, Fargo, N. Dak.) and a guide RNA complex of a crRNA (ZmADH1-B) having the sequence GGCCUCCCAGAAGUAGACGUGUUUUAGAGC-UAUGCU (SEQ ID NO:23) and a tracrRNA (both purchased from Integrated DNA Technologies, Coralville, Iowa). This was used for editing the target gene ADH1 in the maize protoplasts following the procedures described in Example 1. A T7 endonuclease (T7E1, New England Biolabs, Ipswich, Mass.) was used in a heteroduplex cleavage assay to detect on-target editing. In brief, genomic DNA from the protoplasts was amplified by PCR; the amplified products were denatured and re-annealed to allow heteroduplex formation between wild-type or unedited DNA and the edited DNA. T7E1, which recognizes and cleaves mismatched DNA, was used to digest the heteroduplexes, and the resulting cleaved and full-length PCR products are analysed by gel electrophoresis. The primers used for the T7E1 assay had the sequences GAACAGTGCCGCAGTGGCG (forward primer, SEQ ID NO:24) and TACCCTCCAGCCTCGTGGC (reverse primer, SEQ ID NO:25) for an expected amplicon size of 720 base-pairs (i. e., SEQ ID NO:21). Gel electrophoretic analysis demonstrated the presence of the expected cleaved products.

For quantitation of editing efficiency, next-generation sequencing (NGS) analysis was used. A second set of primers were used for CRISPR sequencing; these had the sequences ACTATGCGATTGCTTTCCTGGAC (forward primer, SEQ ID NO:26) and ACCGCGAGTTGTTGTAT-CATATCT (reverse primer, SEQ ID NO:27) for an expected amplicon size of 230 base-pairs which includes the ADH1 first exon (i. e.,

```
ACTATGCGATTGCTTTCCTGGACCCGTGCAGCTGCGGTGGCATGGGAGGC

CGGCAAGCCACTGTCGATCGAGGAGGTGGAGGTAGCGCCTCCGCAGGCCA

TGGAGGTGCGCGTCAAGATCCTCTTCACCTCGCTCTGCCACACCGACGTC

TACTTCTGGGAGGCCAAGGTATCTAATCAGCCATCCCATTTGTGATCTTT

GTCAGTAGATATGATACAACAACTCGCGGT, SEQ ID NO: 28);
``` the ADH1 first exon (SEQ ID NO:22) is indicated by bold, underlined text. The NGS sequencing results are provided in FIGS. 1A-1C. The editing efficiency was estimated to be 38%.

Another gene selected for editing was the maize (*Zea mays*) Babyboom gene BBM2 (see www[dot]maizegdb[dot]org/gene_center/gene/GRMZM2G141638) with the partial genomic sequence:

(SEQ ID NO: 29)
AACCGGTGTAATACATACTAAGGGCTAGTTTGGGAACCCTGGTTTTCTA

AGGAATTTTATTTTTCCAAAAAAAATAGTTTATTTTTCCTTCGGAAATT

AGGAATCTCTTATAAAATTCGAGTTCCCAAACTATTCCTAATATATATA

TCATACTCTCCATCAGTCTATATATAGATTACATATAGTAAGTATAGAG

TATCTCGCTATCACATAGTGCCACTAATCTTCTGGAGTGTACCAGTTGT

ATAAATATCTATCAGTATCAGCACTACTGTTTGCTGAATACCCCAAAAC

TCTCTGCTTGACTTCTCTTCCCTAACCTTTGCACTGTCCAAAATGGCTT

CCTGATCCCCTCACTTCCTCGAATCATTCTAAGAAGAAACTCAAGCCGC

TACCATTAGGGGCAGATTAATTGCTGCACTTTCAGATAATCTACCATGG

CCACTGTGAACAACTGGCTCGCTTTCTCCCTCTCCCCGCAGGAGCTGCC

GCCCTCCCAGACGACGGACTCCACGCTCATCTCGGCCGCCACCGCCGAC

CATGTCTCCGGCGATGTCTGCTTCAACATCCCCCAAGGTAGCATCTATC

TATCTGGCGACATACGTG;

promoter sequence (SEQ ID NO:30), located at nucleotide positions 1-254 of SEQ ID NO:29 is indicated by bold, underlined text and guide RNA (crRNA) sequences were designed to edit this non-coding DNA.

Maize protoplasts were prepared as described in Example 1. A ribonucleoprotein (RNP) was prepared with Cas9 nuclease (Aldevron, Fargo, N. Dak.) and a guide RNA complex of a crRNA (ZmBBM2-2) having the sequence AAGAGAUUCCUAAUUUCCGAGUUUUAGAGC-UAUGCU (SEQ ID NO:31) and a tracrRNA (both purchased from Integrated DNA Technologies, Coralville, Iowa). This was used for editing the target gene BBM2 in the maize protoplasts following the procedures described in Example 1.

For quantitation of editing efficiency, next-generation sequencing (NGS) analysis was used. The primers used for CRISPR sequencing had the sequences GGGAACCCTGGTTTTCTAAG (forward primer, SEQ ID NO:32) and GCAAACAGTAGTGCTGATACTG (reverse primer, SEQ ID NO:33) for an expected amplicon size of 248 base-pairs which includes the BBM2 promoter sequence (i. e.,

GGGAACCCTGGTTTTCTAAGGAATTTTATTTTTCCAAAAAAAATAGTTTA

TTTTTCCTTCGGAAATTAGGAATCTCTTATAAAATTCGAGTTCCCAAACT

ATTCCTAATATATATATCATACTCTCCATCAGTCTATATATAGATTACAT

ATAGTAAGTATAGAGTATCTCGCTATCACATAGTGCCACTAATCTTCTGG

AGTGTACCAGTTGTATAAATATCTATCAGTATCAGCACTACTGTTTGC,

SEQ ID NO: 34);

the BBM2 promoter sequence (SEQ ID NO:30) is indicated by bold, underlined text.

Similar genomic modification is carried out in maize whole plants or in maize plant tissues using procedures as described in Examples 31-34.

Arrayed screens can be conveniently carried out with protoplasts in multi-well (e. g., 24- or 96-well) plates. In embodiments where editing of a target nucleotide sequence is expected to provide an observable phenotype, the phenotype can be used to select the plant cells or protoplasts having the edited sequence. Optionally, the plant cells or plant protoplasts are grown or cultured under conditions that permit expression of the phenotype, allowing selection of the plant cells or plant protoplasts that exhibit the phenotype.

Pooled screens are carried out in a similar fashion, except that editing is carried out with multiple guide RNAs (e. g., in the form of multiple RNPs) provided to a complement of plant protoplasts. For example, maize (*Zea mays*, variety B73) protoplasts are treated with a mixture of RNPs for delivering different gRNAs targeting a selection of 2630 transcription factors in 5 families identified in maize (sequences publicly available at grassius[dot]org/tf_browsefamily.html?species=Maize). Those guides that are over-represented at the read-out stage are those that target genes that are identified as candidates for controlling cell division.

Example 4

This example illustrates a method of integrating sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. More specifically, this non-limiting example illustrates using a ribonucleoprotein (RNP) including a guide RNA (gRNA) and a nuclease to effect a DSB in the genome of a monocot plant, and integration of sequence encoded by a double-stranded DNA (dsDNA) at the site of the DSB.

Experimental details were similar to those described in Example 3. As in Example 3, the target gene selected for editing was the maize (*Zea mays*) alcohol dehydrogenase ADH1 (see www[dot]maizegdb[dot]org/gene_center/gene/GRMZM2G442658) with the partial genomic sequence of SEQ ID NO:21; the first exon (SEQ ID NO:22) is located at nucleotide positions 409-571 of SEQ ID NO:21 and guide RNA (crRNA) sequences were designed to edit this exon.

Maize protoplasts were prepared as described in Examples 1 and 3. A ribonucleoprotein (RNP) was prepared with Cas9 nuclease (Aldevron, Fargo, N. Dak.) and a guide RNA complex of a crRNA (ZmADH1-B) having the sequence GGCCUCCCAGAAGUAGACGUGUUUUA-GAGCUAUGCU (SEQ ID NO:23) and a tracrRNA (both purchased from Integrated DNA Technologies, Coralville, Iowa). A chemically modified double-stranded DNA (dsDNA) molecule of 34 base pairs was produced by annealing one strand having the sequence 5'-GTTTAATT-GAGTTGTCATATGTTAATAACGGTAT-3' (SEQ ID NO:267, which contains an NdeI recognition site at nucleotide positions 16-21 shown as underlined font) and a second strand having the sequence 5'-ATACCGTTATTAA-CATATGACAACTCAATTAAAC-3' (SEQ ID NO:268) (both purchased from Integrated DNA Technologies, Coralville, Iowa); each strand was phosphorylated on the 5' end and contained two phosphorothioate linkages at each terminus (i. e., the two linkages between the most distal three bases on either end of the strand). Transfection procedures for editing the target gene ADH1 in the maize protoplasts were identical to those described in Examples 1 and 3, except the dsDNA was added at a concentration of 1 nanomolar together with the RNP. (In an alternative procedure, the RNP can be added first, followed by the dsDNA.)

A T7 endonuclease (T7E1, New England Biolabs, Ipswich, Mass.) was used in a heteroduplex cleavage assay to detect on-target editing. In brief, genomic DNA from the protoplasts was amplified by PCR; the amplified products were denatured and re-annealed to allow heteroduplex formation between wild-type or unedited DNA and the edited DNA. T7E1, which recognizes and cleaves mismatched DNA, was used to digest the heteroduplexes, and the resulting cleaved and full-length PCR products are analysed by gel electrophoresis. The primers used for the T7E1 assay had the sequences GAACAGTGCCGCAGTGGCG (forward primer, SEQ ID NO:24) and TACCCTCCAGCCTCGTGGC (reverse primer, SEQ ID NO:25) for an expected amplicon size of 720 base-pairs (i. e., SEQ ID NO:21). In a separate endonuclease assay, NdeI restriction enzyme was used. In both the T7E1 and NdeI assays, gel electrophoretic analysis demonstrated the presence of the expected cleavage products.

For quantitation of editing efficiency, next-generation sequencing (NGS) analysis was used. A second set of primers were used for CRISPR sequencing; these had the sequences ACTATGCGATTGCTTTCCTGGAC (forward primer, SEQ ID NO:26) and ACCGCGAGTTGTTGTAT-CATATCT (reverse primer, SEQ ID NO:27) for an expected amplicon size of 230 base-pairs (SEQ ID NO:28) which includes the ADH1 first exon (SEQ ID NO:22). The NGS sequencing results are provided in FIGS. 2A-2D, depicting the alignments of the cloned sequences SEQ ID NOs:269-304. The editing efficiency (percentage of the total population of cells in which DSB is correctly induced in the genome) was estimated to be 23% and the insertion efficiency (percentage of the total population of cells in which the dsDNA molecule is successfully introduced at the DSB correctly located in the genome) was estimated to be 17%.

Additional experiments were carried out using the same procedure for editing the ADH1 maize gene, using variations of the 34-base-pair chemically modified dsDNA molecule (all purchased from Integrated DNA Technologies, Coralville, Iowa) provided at 1 nanomolar together with the RNP to maize protoplasts. In one set of experiments, the dsDNA molecule was provided by annealing one DNA strand having the sequence of SEQ ID NO:267 and a second DNA strand having the sequence (SEQ ID NO:268); each strand was phosphorylated on the 5' end but contained no phosphorothioate linkages. In a second set of experiments, the dsDNA molecule was provided by annealing one DNA strand having the sequence of SEQ ID NO:267 and a second DNA strand having the sequence (SEQ ID NO:268); each strand was phosphorylated on the 5' end and contained four phosphorothioate linkages at each terminus (i. e., the four linkages between the most distal five bases on either end of the strand). In a second set of experiments, the dsDNA molecule was provided by annealing one DNA strand having the sequence of SEQ ID NO:267 and that was phosphorylated on the 5' end and contained two phosphorothioate linkages at each terminus (i. e., the two linkages between the most distal three bases on either end of the strand), and a second DNA strand having the sequence (SEQ ID NO:268) and that contained two phosphorothioate linkages at each terminus (i. e., the two linkages between the most distal three bases on either end of the strand) but was not phosphorylated on the 5' end.

Similar genomic modification is carried out in maize whole plants or in maize plant tissues using procedures as described in Examples 31-34.

Example 5

This example illustrates a method of changing expression of a sequence of interest in a genome, comprising integrating sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. More specifically, this non-limiting example illustrates using a ribonucleoprotein (RNP) including a guide RNA (gRNA) and a nuclease to effect a DSB in the genome of a monocot plant, and integration of sequence encoded by a double-stranded DNA (dsDNA) at the site of the DSB, wherein the sequence encoded by the dsDNA molecule includes a sequence recognizable by a specific binding agent, and wherein contacting the integrated sequence encoded by the dsDNA molecule with the specific binding agent results in a change of expression of a sequence of interest. In this particular example, sequence encoded by the dsDNA molecule is integrated at a DSB located in non-coding genomic sequence (i. e., in a promoter region), the sequence recognizable by a specific binding agent includes an auxin response element (AuxRE) sequence, the specific binding agent is an auxin (e. g., an exogenously applied auxin), and the change of expression is upregulation of the sequence of interest.

Experimental details were similar to those described in Examples 3 and 4. The target gene selected for editing was non-coding sequence, in this case the partial promoter sequence (sequence upstream of the transcription start site) of the maize (*Zea mays*) Lc gene (see www[dot]maizegdb[dot]org/gene_center/gene/GRMZM5G822829) with the sequence of (SEQ ID NO: 305)
GGGTTGTTGTGGGTTGAACCCGTCCCAACCATCATCAACTCGCTAG

CCAAACACACGCTTAGGGGCCAAAGCAGTGCTATAATATGAGTGGT

GGCGCTATTATATATAGCGTCAGAGAACTTAGATCTGATATTCTGA

TGAAGAAAAAATGACTTTACTGACTACGAAAGAAGAAGAAAGGAGC

TATAGAGAGAGAGAAAAAGAGGGGTCGTGTAGTGCTTAAACTGTAC

ATGAACAGCAGTAGTGTTACAGAAGCTAAACTCAACCAGAGCTCCA

CCAAAGACAAAGAGGGTCTACTTCCATCACCGTCTTGCTCGGTCAC

TTGGAGCTCTGTCCATAAATTAAACCCATCTTGGATCCCAAGGTTC

GTGGCATATCTGTAGGCATCTACCCCGTCTTCGTCGTCCGCTCCTC

ACTAGCTACCAAGAGGTCGCCATTATTGCCAACATAGAGTGTACGT

GGATGTCTATATATATGCCTACTTGCACCCATATGGC;

and guide RNA (crRNA) sequences were designed to edit this non-coding sequence.

Maize protoplasts were prepared as described in Examples 1, 3, and 4. A ribonucleoprotein (RNP) was prepared with Cas9 nuclease (Aldevron, Fargo, N. Dak.) and a guide RNA complex of a crRNA (ZmLc Pro-1) having the sequence GCUCCUCACUAGCUACCAAGGUUUUA-GAGCUAUGCU (SEQ ID NO:306) and a tracrRNA (both purchased from Integrated DNA Technologies, Coralville, Iowa). Three different lengths of chemically modified double-stranded DNA (dsDNA) molecules were used in this experiment, with each dsDNA added at a concentration of 1 nanomolar together with the RNP. The transfection procedures for editing the target gene Lc in the maize protoplasts were otherwise identical to those described in Example 4.

All dsDNA molecules were purchased from Integrated DNA Technologies, Coralville, Iowa. One dsDNA ("3× DR5") molecule of 34 base pairs was produced by annealing a first strand having the sequence 5'-ccgacaaaaggccgacaaaaggccgacaaaaggt-3' (SEQ ID NO:306) and a second strand having the sequence 5'-acctttgtcggccttttgtcggccttttgtcgg-3' (SEQ ID NO:307, which includes three concatenated copies of an auxin response element having the sequence ccttttgtcgg (SEQ ID NO:308)). A second dsDNA ("6xDR5") molecule of 68 base pairs was produced by annealing a first strand having the sequence 5'-GCCGACAAAAGGCCGACAAAAGG-CCGACAAAAGGCCGACAAAAGGCCGACAAAAGG-CCGA CAAAAGGT-3' (SEQ ID NO:309) and a second strand having the sequence 5'-ACCTTTTGTC-GGCCTTTTGTCGGCCTTTTGTCGGCCTTTTGTCGG-CCTTTTGTCGGCCTTTTGT CGGC-3' (SEQ ID NO:310, which includes six concatenated copies of the auxin response element having the sequence SEQ ID NO:308). A third dsDNA ("9xDR5") molecule of 100 base pairs was produced by annealing a first strand having the sequence 5'-CCGACAAAAGGCCGACAAAAGGCCGACAAAA-GGCCGACAAAAGGCCGACAAAAGGCCGAC AAAAGGCCGACAAAAGGCCGACAAAAGGCCGAC-AAAAGGT-3' (SEQ ID NO:311) and a second strand having the sequence 5'-ACCTTTTGTCGGCC-TTTTGTCGGCCTTTTGTCGGCCTTTTGTCGGCCTT-TTGTCGGCCTTTTGT CGGCCTTTTGTCGGCCTTTTGTCGGCCTTTTGTCGG-3' (SEQ ID NO:312 which includes nine concatenated copies of the auxin response element having the sequence SEQ ID NO:308). In all cases, each strand was phosphorylated on the 5' end and contained two phosphorothioate linkages at each terminus (i. e., the two linkages between the most distal three bases on either end of the strand).

For quantitation of editing efficiency, next-generation sequencing (NGS) analysis was used. A second set of primers were used for CRISPR sequencing; these had the sequences CTCCACCAAAGACAAAGAGGG (forward primer, SEQ ID NO:313) and GCCATATGGGTGCAAGTAGGC (reverse primer, SEQ ID NO:314) for an expected amplicon size of 226 base-pairs (SEQ ID NO:315). Based on the NGS sequencing results, the editing efficiency (percentage of the total population of cells in which DSB is correctly induced in the genome) for the 3xDR5 insertion was estimated to be 34% and the insertion efficiency (percentage of the total population of cells in which the dsDNA molecule is successfully introduced at the DSB correctly located in the genome) was estimated to be 21%; for the 6xDR5 insertion, the editing efficiency was estimated to be 25% and the insertion efficiency was estimated to be 3%; and for the 9xDR5 insertion, the editing efficiency was estimated to be 11% and the insertion efficiency was estimated to be less than 1%.

All of the dsDNA molecules were designed to contain at least one sequence recognizable by a specific binding agent, in this case multiple copies of an auxin response element (SEQ ID NO:308). As the dsDNA molecules were integrated at the site of a DSB in promoter sequence operably linked to the gene of interest (the endogenous maize Lc gene), and the culture medium contained an herbicide (2,4-dichlorophenoxyacetic acid) with auxin-like properties, expression of the gene of interest (the Lc gene) was expected to increase in cells that had the dsDNA molecule integrated into their genome, relative to that in cells that did not have the dsDNA molecule integrated into their genome. Quantitative RT-PCR was employed on three technical replicates per treatment to measure the relative expression of the Lc gene. Controls were cells that had been subjected to the transfection procedure without an RNP. Results are provided in Table 1 with Lc gene expression levels normalized to tubulin. These data demonstrate that, in each case, integration of the dsDNA molecules containing the auxin response factor sequences into the Lc promoter region resulted in very strong upregulation of Lc expression in the presence of auxin.

TABLE 1

| Treatment | Lc relative expression | standard deviation | Increase in relative expression |
|---|---|---|---|
| dsDNA = 3xDR5 | 3863.48 | 174.46 | 304-fold |
| dsDNA = 6xDR5 | 1479.15 | 74.99 | 116-fold |
| dsDNA = 9xDR5 | 1030.89 | 28.01 | 81-fold |
| RNP alone (no dsDNA) | 12.72 | 2.63 | 1 |
| no RNP | 1.02 | 0.25 | n.a. |

Example 6

This example illustrates a method of changing expression of a sequence of interest in a genome, comprising integrating sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. This example illustrates introducing at least two DSBs into a genome by one or more nucleases in such a way that genomic sequence is deleted between the DSBs (leaving a deletion with blunt ends, overhangs or a combination of a blunt end and an overhang), and sequence encoded by at least one polynucleotide molecule is integrated between the DSBs (i. e., sequence encoded by at least one individual polynucleotide molecule is integrated at the location of the deleted genomic sequence). In an embodiment, the polynucleotide molecule includes one or more strands containing chemically modified DNA. Embodiments include double-stranded DNA or double-stranded DNA/RNA hybrid molecules, and single-stranded DNA or single-stranded DNA/RNA hybrid molecules, the sequence of which in analogous procedures is integrated at the location of genomic sequence that has been deleted between two DSBs. More specifically, this non-limiting example illustrates using multiple different ribonucleoproteins (RNPs), wherein each RNP includes a guide RNA (gRNA) and a nuclease, to effect multiple DSBs in the genome of a monocot plant, and integration of sequence encoded by a double-stranded DNA (dsDNA) at the location of the genomic sequence that is deleted between two DSBs. In this particular example, the sequence encoded by the dsDNA molecule includes a sequence recognizable by a specific binding agent and is integrated between two DSBs that are introduced into non-coding genomic sequence (i. e., in a promoter region); the sequence recognizable by a specific binding agent includes an auxin response element (AuxRE) sequence, the specific binding agent is an auxin (e. g., an exogenously applied auxin), and contacting the integrated dsDNA molecule with the specific binding agent results in a change of expression of the sequence of interest (upregulation of the gene to which the promoter is operably linked). This example also illustrates a method to modify expression of a sequence of interest (e. g., increased or decreased levels of the sequence's transcript or of a polypeptide encoded by the sequence, a change in stability of the sequence's transcript, or a change in the expression pattern of the sequence) by modifying a region of the genome that is operably linked to the sequence of interest, i. e., modification of that operably linked genomic region results in a change the expression level or expression pattern of the sequence of interest.

Experimental details were similar to those described in Examples 3, 4, and 5. The target gene selected for editing was non-coding sequence, in this case the partial promoter sequence (sequence upstream of the transcription start site) of the maize (*Zea mays*) Lc gene (see www[dot]maizegdb[dot]org/gene_center/gene/GRMZM5G822829) with the sequence of (SEQ ID NO: 305)
GGGTTGTTGTGGGTTGAACCCGTCCCAACCATCATCAACTCGCTAG

CCAAACACACGCTTAGGGGCCAAAGCAGTGCTATAATATGAGTGGT

GGCGCTATTATATATAGCGTCAGAGAACTTAGATCTGATATTCTGA

TGAAGAAAAAATGACTTTACTGACTACGAAAGAAGAAGAAAGGAGC

TATAGAGAGAGAAAAAGAGGGGTCGTGTAGTGCTTAAACTGTAC

ATGAACAGCAGTAGTGTTACAGAAGCTAAACTCAACCAGAGCTCCA

CCAAAGACAAAGAGGGTCTACTTCCATCACCGTCTTGCTCGGTCAC

TTGGAGCTCTGTCCATAAATTAAACCCATCTTGGATCCCAAGGTTC

GTGGCATATCTGTAGGCATCTACCCCGTCTTCGTCGTCCGCTCCTC

ACTAGCTACCAAGAGGTCGCCATTATTGCCAACATAGAGTGTACGT

GGATGTCTATATATATGCCTACTTGCACCCATATGGC;

and guide RNA (crRNA) sequences were designed to edit this non-coding sequence.

Maize protoplasts were prepared as described in Examples 1, 3, 4, and 5. Ribonucleoproteins (RNPs) were prepared with Cas9 nuclease (Aldevron, Fargo, N. Dak.) and guide RNA complexes. Two guide RNA complexes were made with a crRNA and a tracrRNA (crRNAs and tracrRNA were purchased from Integrated DNA Technologies, Coralville, Iowa); the first guide RNA complex used a crRNA (ZmLc Pro-1) having the sequence GCUCCUCACUAGCUACCAAGGUUUUAGAGCUAUGCU (SEQ ID NO:306) and the second guide RNA complex used a crRNA (ZmLc Pro-3) having the sequence CUCCAAGUGACCGAGCAAGAGUUUUAGAGCUAUGCU (SEQ ID NO:334).

Three different lengths of chemically modified double-stranded DNA (dsDNA) molecules were used in this experiment, with each dsDNA added at a concentration of 1 nanomolar together with the RNP. The transfection procedures for editing the target gene Lc in the maize protoplasts were otherwise identical to those described in Example 4 and 5. All dsDNA molecules were purchased from Integrated DNA Technologies, Coralville, Iowa. One dsDNA ("3×DR5") molecule of 34 base pairs was produced by annealing a first strand having the sequence 5'-ccgacaaaaggccgacaaaaggccgacaaaaggt-3' (SEQ ID NO:306) and a second strand having the sequence 5'-accttttgtcggccttttgtcggccttttgtcgg-3' (SEQ ID NO:307), which includes three concatenated copies of an auxin response element having the sequence ccttttgtcgg (SEQ ID NO:308)). A second dsDNA ("6×DR5") molecule of 68 base pairs was produced by annealing a first strand having the sequence 5'-GCCGACAAAAGGCCGACAAAAGG-CCGACAAAAGGCCGACAAAAGGCCGACAAAAG-GCCGA CAAAAGGT-3' (SEQ ID NO:309) and a second strand having the sequence 5'-ACCTTTTGTCGG-CCTTTTGTCGGCCTTTTGTCGGCCTTTTGTCGGCC-TTTTGTCGGCCTTTTGT CGGC-3' (SEQ ID NO:310, which includes six concatenated copies of the auxin response element having the sequence SEQ ID NO:308). A third dsDNA ("9×DR5") molecule of 100 base pairs was produced by annealing a first strand having the sequence 5'-CCGACAAAAGGCCGACAAAAGGCCGACAAAA-GGCCGACAAAAGGCCGACAAAAGGCCGAC AAAAGGCCGACAAAAGGCCGACAAAAGGCCGA-CAAAAGGT-3' (SEQ ID NO:311) and a second strand having the sequence 5'-ACCTTTTGTCGGCC-TTTTGTCGGCCTTTTGTCGGCCTTTTGTCGGCCTT-TTGTCGGCCTTTTGT CGGCCTTTTGTCGGCCTTTTGTCGGCCTTTTGTCGG-3' (SEQ ID NO:312 which includes nine concatenated copies of the auxin response element having the sequence SEQ ID NO:308). In all cases, each strand was phosphorylated on the 5' end and contained two phosphorothioate linkages at each terminus (i. e., the two linkages between the most distal three bases on either end of the strand).

For quantitation of editing efficiency, next-generation sequencing (NGS) analysis was used. A second set of primers were used for CRISPR sequencing; these had the sequences CTCCACCAAAGACAAAGAGGG (forward primer, SEQ ID NO:313) and GCCATATGGGTGCAAGTAGGC (reverse primer, SEQ ID NO:314) for an expected amplicon size of 226 base-pairs (SEQ ID NO:315).

All of the dsDNA molecules were designed to contain at least one sequence recognizable by a specific binding agent, in this case multiple copies of an auxin response element (SEQ ID NO:308). In this example, the dsDNA molecules were integrated at the site where non-coding genomic sequence was deleted (i. e., integrated between the DSBs introduced at two discrete locations in the genome, in this case in the Lc promoter). This effected replacement of part of the Lc promoter sequence with multiple copies of the auxin response element. As the culture medium contained an herbicide (2,4-dichlorophenoxyacetic acid) with auxin-like properties, expression of the gene of interest (the endogenous maize Lc gene) operably linked to the Lc promoter sequence was expected to increase in cells that had any of the dsDNA molecules integrated into their genome, relative to that in cells that did not have a dsDNA molecule integrated into their genome.

Quantitative RT-PCR was employed on three technical replicates per treatment to measure the relative expression of the Lc gene. Results are provided in Table 2 with relative Lc gene expression levels normalized to tubulin. These data demonstrate that, in each case, integration of sequence encoded by the dsDNA molecules containing the auxin response factor sequences into the Lc promoter region resulted in very strong upregulation of Lc expression in the presence of an exogenously provided auxin. The strongest upregulation of Lc expression was observed in the treatment using both the ZmLc Pro-1 and ZmLc Pro-3 RNPs (e. g., >40-fold increase observed with the 3×DR5 dsDNA and >35-fold increase observed with the 6×DR5, relative to controls transfected without any RNP), which may indicate that introduction of two DSBs into the genome and integration of sequence encoded by the dsDNA molecule between the two DSBs provided greater efficacy than introducing either of the two DSBs individually into the genome and integrating sequence encoded by the dsDNA molecule at the site of the individual DSB

TABLE 2

| crRNA | No oligo | | 3x | | 6x | | 9x | |
|---|---|---|---|---|---|---|---|---|
| | Average | STD | Average | STD | Average | STD | Average | STD |
| ZmLc Pro-1 | 1.0 | 0.04 | 25.5 | 0.86 | 17.8 | 0.30 | 1.1 | 0.04 |
| ZmLc Pro-3 | 1.0 | 0.05 | 32.7 | 0.91 | 27.7 | 2.43 | 1.5 | 0.48 |
| ZmLc Pro-1 + ZmLc Pro-3 | 1.0 | 0.04 | 41.4 | 0.73 | 36.7 | 1.65 | 4.3 | 0.27 |

Similar genomic modification is carried out in maize whole plants or in maize plant tissues using procedures as described in Examples 31-34. In a non-limiting example, similar genomic modification is carried out with AsCas12a or "AsCpf1" (from *Acidaminococcus* sp.) and LbCas12a or "LbCpf1" (from *Lachnospiraceae* bacteria) nuclease; see, e.g., Zetsche et al. (2015) *Cell*, 163:759-771; U.S. Pat. No. 9,790,490. A ribonucleoprotein (RNP) is prepared with AsCas12a (Aldevron, Fargo, N. Dak.) and a guide RNA complex including a crRNA (ZmLc Pro-Cpf1) having the sequence UAAUUUCUACUCUUGUA-GAUUGGACAGAGCUCCAAGUGACC (SEQ ID NO:1020). The transfection procedures with different lengths (3×DR5, 6×DR5, and 9×DR5) of chemically modified double-stranded DNA (dsDNA) molecules together with the AsCpf1 or LbCpf1 RNPs are essentially the same as those described above for the Cas9 RNP transfections.

One of skill in the art would recognize that there are alternative methods for introducing DSBs into the genome (e. g., use of CRISPR nucleases other than Cas9, such as CasX, CasY, and Cpf1, zinc-finger nucleases (ZFNs), transcription activator-like effector nucleases (TAL-effector nucleases or TALENs), Argonaute proteins, or a meganuclease or engineered meganuclease) and thus similar embodiments of the approach described herein include use of any of these methods for introducing two or more DSBs into a genome in such a way that genomic sequence is deleted between the DSBs, and integration of at least one polynucleotide (such as a double-stranded DNA, a single-stranded DNA, a single-stranded DNA/RNA hybrid, or a double-stranded DNA/RNA hybrid) molecule at the location of the genomic sequence that is deleted between the DSBs.

Example 7

This example illustrates a method of modifying a sequence of interest in a genome, comprising integrating sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. This example illustrates introducing at least two DSBs into a genome by one or more nucleases in such a way that genomic sequence is deleted between the DSBs (leaving a deletion with blunt ends, overhangs or a combination of a blunt end and an overhang), and sequence encoded by at least one polynucleotide molecule is integrated between the DSBs (i. e., sequence encoded by at least one individual polynucleotide molecule is integrated at the location of the deleted genomic sequence), thus replacing the deleted genomic sequence. More specifically, this non-limiting example illustrates using multiple different ribonucleoproteins (RNPs), wherein each RNP includes a guide RNA (gRNA) and a nuclease, to effect multiple DSBs in the genome of a monocot plant, and integration of sequence encoded by a double-stranded DNA (dsDNA) at the location of the genomic sequence that is deleted between two DSBs.

In embodiments, this technique is useful, e. g., for replacing regions of genomic sequence such as one or more exons ("exon exchange") or one or more protein domains. In an example, DSBs are introduced into intronic sequence on each side of an exon, resulting in deletion of the exon, and—when sequence encoded by at least one dsDNA molecule is integrated at the location of the deleted exon—incorporation of a "replacement" exon. This technique avoids editing inaccuracies such as unintentional nucleotide changes, deletions, or additions at the nuclease cleavage sites in the resulting exon sequence or the messenger RNA encoded by the exon. In the particular example described below, this technique is used to replace a "wild-type" exon (an exon having unmodified, native sequence) of the maize EPSPS genomic sequence with a modified exon sequence that encodes an EPSPS protein having resistance to glyphosate.

Experimental details were similar to those described in Examples 3, 4, and 5. The target gene selected for editing was the maize (*Zea mays*, B73 line) enolpyruvylshikimate phosphate synthase1 (EPSPS) gene (see www[dot]maizegdb [dot]org/gene_center/gene/Zm00001d045450) with the partial genomic sequence of (SEQ ID NO: 335)
acaacaaaaaaaggtaa<u>cct</u>cgctactaacataacaaaatacttgt tgcttattaattatatgttttttaatctttgatcAGGGGACAACAG

TGGTTGATAACCTGTTGAACAGTGAGGATGTCCACTACATGCTCGG

GGCCTTGAGGACTCTTGGTCTCTCTGTCGAAGCGGACAAAGCTGCC

AAAAGAGCTGTAGTTGTTGGCTGTGGTGGAAAGTTCCCAGTTGAGG

ATTCTAAAGAGGAAGTGCAGCTCTTCTTGGGGAATGCTGGAACTGC

AATGC*ggagttagtatgaaacccat*<u>ggg</u>tatgtctagt;

a first intronic sequence (nucleotides 1-80 of SEQ ID NO:335) and a second intronic sequence (nucleotides 325-392 of SEQ ID NO:335) are given in lower-case font, exonic sequence (nucleotides 81-324 of SEQ ID NO:335) is given in upper-case font, a first crRNA (guide RNA) target site sequence (nucleotides 21-40 of SEQ ID NO:335) and a second crRNA (guide RNA) target site sequence (nucleotides 360-379 of SEQ ID NO:335) are italicized and the PAM sites (nucleotides 18-20 and nucleotides 380-382 of SEQ ID NO:335) are underlined.

Maize protoplasts were prepared as described in Examples 1, 3, 4, 5, and 6. Ribonucleoproteins (RNPs) were prepared with Cas9 nuclease (Aldevron, Fargo, N. Dak.) and guide RNA complexes. Two guide RNA complexes were made with a crRNA and a tracrRNA (crRNAs and tracrRNA were purchased from Integrated DNA Technologies, Coralville, Iowa); the first guide RNA complex used a crRNA (EPS-gRNA-1) having the sequence AUUUUGUUAU-GUUAGUAGCGGUUUUAGAGCUAUGCU (SEQ ID NO:336) and the second guide RNA complex used a crRNA (EPS-gRNA-2) having the sequence GGAGUU-AGUAUGAAACCCAUGUUUUAGAGCUAUGCU (SEQ ID NO:337).

A dsDNA molecule was prepared by PCR using primers and a template purchased from Integrated DNA Technologies, Coralville, Iowa. The primers were had the sequences 5'-P-T*A*CTAACATAACAAAATACTTGT (forward primer, SEQ ID NO:338) and 5'-P-G*G*TTTCATACTAACTCCAGCAAG (reverse primer, SEQ ID NO:339), where P represents a 5' phosphorylation and * indicates a phosphorothioate linkage. The template sequence is given by 5'-TACTAACAT-AACAAAATACTTGTTGCTTATTAATTATATGTTTTT-TAATCTTTGATCAGGGGA CAACAGTGGTTGA-TAACCTGTTGAACAGTGAGGATGTCCACTACATG-CTCGGGGCCTTGAGG
ACTCTTGGTCTCTCTGTCGAAGCGGACAAAGCTGC-CAAAAGAGCTGTAGTTGTTGGCTGTGG TGGAAAGTTCCCAGTTGAGGATTCTAAAGAG-GAAGTGCAGCTCTTCTTGGGGAATGCTGGAA TTGCAATGCGGGCATTGACAGCAGCTGT-TACTGCTGCTGGTGGAAATGCAACGTATGTTTCC TCTCTTTCTCTCTACAATACTTGCTGGAGTTAGTAT-GAAACC-3' (SEQ ID NO:340), with nucleotide changes (relative to the wild-type sequence) at positions 250 and 261 (indicated by underlined font) of SEQ ID NO:340 to provide the amino acid mutations T102I and P106A in the mature protein, which are point mutations found in glyphosate-resistant EPSPS.

Similar genomic modification is carried out in maize whole plants or in maize plant tissues using procedures as described in Examples 31-34.

NGS sequencing data indicated that the replacement exon sequence encoded by the dsDNA molecule was correctly integrated at the location of the deleted exon. The EPSPS genomic sequence of 0.48% of the total reads included the nucleotide changes (relative to the wild-type sequence) at positions 250-261 of SEQ ID NO:340, to provide the amino acid mutations T102I and P106A in the mature protein; this was accompanied by deletion of part of the intronic sequence 3' to the modified exon.

In a related embodiment, the sequence encoding a small RNA recognition site for a small RNA (e. g., an siRNA or a miRNA) expressed only in a specific tissue (for example, miRNAs specifically expressed in male reproductive tissue or female reproductive tissue, e. g., the miRNAs disclosed in Table 6 of U.S. Pat. No. 8,334,430, incorporated herein by reference and including the sequences provided herein in Table A and B, or the siRNAs disclosed in U.S. Pat. No. 9,139,838, incorporated herein by reference and including the sequences provided herein in Table C), encoded by a polynucleotide (such as a double-stranded DNA, a single-stranded DNA, a single-stranded DNA/RNA hybrid, or a double-stranded DNA/RNA hybrid) donor molecule, is further integrated elsewhere in the EPSPS genomic sequence, e. g., in the 3' untranslated region. This limits expression of the glyphosate-resistant EPSPS protein to tissues other than those in which the small RNA is endogenously expressed, and leaves the male reproductive tissue or female reproductive tissue susceptible to glyphosate; this approach is useful for providing male-sterile or female-sterile plants. Table A provides the RNA sequences of miRNA recognition sites recognized and cleaved by mature miRNAs specifically expressed in maize female reproductive tissue (e. g., ovule, embryo). Table B provides the RNA sequences of miRNA or siRNA recognition sites recognized and cleaved by mature miRNAs specifically expressed in maize male reproductive tissue (e. g., pollen, tassel). Table C provides DNA sequences encoding "male tissue-specific siRNA elements" (see U.S. Pat. No. 9,139,838, incorporated herein by reference) which can similarly be integrated into a maize genome so that a transcript including one or more of these male tissue-specific siRNA elements is suppressed in maize male reproductive tissue. Integration into the maize genome of one or more DNA sequences encoding these small RNA (miRNA or siRNA) recognition sites is broadly useful for placing a transcript that includes one or more of these small RNA recognition sites under regulation by the mature small RNA(s) corresponding to the recognition site, and resulting in tissue-specific suppression of the transcript in male or female reproductive tissue. In a broader context, integration of DNA encoding one or more small RNA (e. g., miRNA or siRNA) recognition site into genomic sequence encoding a transcript of interest is useful for placing that transcript under regulation of the corresponding small RNA; depending on the expression pattern of the corresponding small RNA, this allows, e. g., specific spatial or temporal or developmental expression of the transcript.

TABLE A

| SEQ ID NO: | RNA sequence of recognition site corresponding to mature miRNA expressed in maize female reproductive tissue |
|---|---|
| SEQ ID NO: 954 | GUGCUCUCUCUCUUCUGUCA |
| SEQ ID NO: 955 | CUGCUCUCUCUCUUCUGUCA |
| SEQ ID NO: 956 | UUGCUUACUCUCUUCUGUCA |
| SEQ ID NO: 957 | CCGCUCUCUCUCUUCUGUCA |
| SEQ ID NO: 958 | UGGAGCUCCCUUCAUUCCAAU |
| SEQ ID NO: 959 | UCGAGUUCCCUUCAUUCCAAU |
| SEQ ID NO: 960 | AUGAGCUCUCUUCAAACCAAA |
| SEQ ID NO: 961 | UGGAGCUCCCUUCAUUCCAAG |
| SEQ ID NO: 962 | UAGAGCUUCCUUCAAACCAAA |
| SEQ ID NO: 963 | UGGAGCUCCAUUCGAUCCAAA |
| SEQ ID NO: 964 | AGCAGCUCCCUUCAAACCAAA |
| SEQ ID NO: 965 | CAGAGCUCCCUUCACUCCAAU |
| SEQ ID NO: 966 | UGGAGCUCCCUUCACUCCAAU |
| SEQ ID NO: 967 | UGGAGCUCCCUUCACUCCAAG |
| SEQ ID NO: 968 | UGGAGCUCCCUUUAAUCCAAU |
| SEQ ID NO: 969 | UUGGGAUGAAGCCUGGUCCGG |
| SEQ ID NO: 970 | CUGGGAUGAAGCCUGGUCCGG |
| SEQ ID NO: 971 | CUGGAAUGAAGCCUGGUCCGG |
| SEQ ID NO: 972 | CGGGAUGAAGCCUGGUCCGG |
| SEQ ID NO: 973 | GAGAUCAGGCUGGCAGCUUGU |
| SEQ ID NO: 974 | UAGAUCAGGCUGGCAGCUUGU |
| SEQ ID NO: 975 | AAGAUCAGGCUGGCAGCUUGU |

TABLE B

| SEQ ID NO: | RNA sequence of recognition site corresponding to mature miRNA expressed in maize male reproductive tissue |
|---|---|
| SEQ ID NO: 976 | GUGCUCUCUCUCUUCUGUCA |
| SEQ ID NO: 977 | CUGCUCUCUCUCUUCUGUCA |
| SEQ ID NO: 978 | UUGCUUACUCUCUUCUGUCA |
| SEQ ID NO: 979 | CCGCUCUCUCUCUUCUGUCA |
| SEQ ID NO: 980 | UGGCAUGCAGGGAGCCAGGCA |
| SEQ ID NO: 981 | AGGAAUACAGGGAGCCAGGCA |
| SEQ ID NO: 982 | GGGUUUACAGGGAGCCAGGCA |
| SEQ ID NO: 983 | AGGCAUACAGGGAGCCAGGCA |
| SEQ ID NO: 984 | AAACAAUGCGAUCCCUUUGGA |
| SEQ ID NO: 985 | AGACCAUGCGAUCCCUUUGGA |
| SEQ ID NO: 986 | GGUCAGAGCGAUCCCUUUGGC |
| SEQ ID NO: 987 | AGACAAUGCGAUCCCUUUGGA |
| SEQ ID NO: 988 | UCGUUCAAGAAAGCCUGUGGAA |
| SEQ ID NO: 989 | CGUUCAAGAAAGCCUGUGGAA |
| SEQ ID NO: 990 | UCGUUCAAGAAAGCAUGUGGAA |
| SEQ ID NO: 991 | ACGUUCAAGAAAGCUUGUGGAA |
| SEQ ID NO: 992 | CGUUCAAGAAAGCCUGUGGAA |

TABLE C

| SEQ ID NO: | DNA sequence including recognition sites corresponding to tassel-specific siRNAs expressed in maize male reproductive tissue |
|---|---|
| SEQ ID NO: 993 | GGACAACAAGCACCTTCTTGCCTTGCAAGGCCTCCCTTCCCTATGG<br>TAGCCACTTGAGTGGATGACTTCACCTTAAAGCTATTGATTCCCTA<br>AGTGCCAGACATAATAGGCTATACATTCTCTCTGGTGGCAACAATG<br>AGCCATTTTGGTTGGTGTGGTAGTCTATTATTGAGTTTTTTTTGGC<br>ACCGTACTCCCATGGAGAGTAGAAGACAAACTCTTCACCGTTGTAG<br>TCGTTGATGGTATTGGTGGTGACGACATCCTTGGTGTGCATGCACT<br>GGTGAGTCACTGTTGTACTCGGCG |
| SEQ ID NO: 994 | GGACAACAAGCACCTTCTTGCCTTGCAAGGCCTCCCTTCCCTATGG<br>TAGCCACTTGAGTGGATGACTTCACCTTAAAGCTATCGATTCCCTA<br>AGTGCCAGACAT |
| SEQ ID NO: 995 | CTCTTCACCGTTGTAGTCGTTGATGGTATTGGTGGTGACGACATCC<br>TTGGTGTGCATGCACTGGTGAGTCACTGTTGTAC |
| SEQ ID NO: 996 | GGACAACAAGCACCTTCTTGCCTTGCAAGGCCTCCCTTCCCTATGG<br>TAGCCACTTGAGTGGATGACTTCACCTTAAAGCTATCGATTCCCTA<br>AGTGCCAGACATCTCTTCACCGTTGTAGTCGTTGATGGTATTGGTG<br>GTGACGACATCCTTGGTGTGCATGCACTGGTGAGTCACTGTTGTAC |

Example 8

This example illustrates a method of changing expression of a sequence of interest in a genome, comprising integrating sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. More specifically, this non-limiting example illustrates using a ribonucleoprotein (RNP) including a guide RNA (gRNA) and a nuclease to effect a DSB in the genome of a monocot plant, and integration of sequence encoded by a polynucleotide molecule at the site of the DSB, wherein sequence encoded by the polynucleotide molecule includes a sequence recognizable by a specific binding agent, and wherein contacting the integrated sequence encoded by polynucleotide molecule with the specific binding agent results in a change of expression of a sequence of interest. In this particular example, sequence encoded by the polynucleotide molecule is integrated at a DSB located in non-coding genomic sequence (i.e., in a promoter region), the sequence recognizable by a specific binding agent includes an endogenous maize enhancer element that was identified by homology to a bacterial enhancer element and that in maize cells demonstrated at least partial responsiveness to auxin, the specific binding agent is an auxin, and the change of expression is upregulation of the sequence of interest.

The ocs enhancer element is a 16 nucleotide sequence, ACGTAAGCGCTTACGT (SEQ ID NO:341) that was originally identified from the 5' untranslated region of the octopine synthase gene of the soil bacterium *Agrobacterium* sp., and is a palindromic sequence, i.e., has a reverse complement that is the exact same nucleotide sequence. A 16 base-pair dsDNA molecule having one strand with the sequence of SEQ ID NO:341 and the other strand being the reverse complement was designed. Endogenous maize sequences having homology to the bacterial enhancer sequence were identified from *Zea mays* B73 genomic data, including the 15 nucleotide sequence, ACGTAAGCGCTTACG (SEQ ID NO:342, located on chromosome 6) and the 12 nucleotide sequence, GTAAGCGCTTAC (SEQ ID NO:343, located on chromosome 10 and is palindromic). These sequences were used to design a first chemically modified dsDNA molecule of 15 base-pairs (with one strand having the sequence of SEQ ID NO:342 and the other strand being the reverse complement) and a second dsDNA molecule of 12 base-pairs (with one strand having the sequence of SEQ ID NO:343 and the other strand being the reverse complement), respectively. For comparison, the 34 base-pair dsDNA ("3×DR5") molecule (with strands having the sequences of SEQ ID NO:306 and SEQ ID NO:307), which contains three copies of an auxin response element (SEQ ID NO:308), was used. All dsDNA molecules were purchased from Integrated DNA Technologies, Coralville, Iowa. In all cases, each strand was phosphorylated on the 5' end and contained two phosphorothioate linkages at each terminus (i. e., the two linkages between the most distal three bases on either end of the strand).

Experimental details were similar to those described, e. g., in Examples 3, 4, and 5. The target gene selected for editing was non-coding sequence, in this case the partial promoter sequence (sequence upstream of the transcription start site) of the maize (*Zea mays*) Lc gene (see www[dot]maizegdb [dot]org/gene_center/gene/GRMZM5G822829) having the sequence of SEQ ID NO:305; and guide RNA (crRNA) sequences were designed to edit this non-coding sequence.

Maize protoplasts were prepared as described, e. g., in Examples 1, 3, 4, and 5. A ribonucleoprotein (RNP) was prepared with Cas9 nuclease (Aldevron, Fargo, N. Dak.) and a guide RNA complex of a crRNA (ZmLc Pro-1) having the sequence of SEQ ID NO:306 and a tracrRNA (both purchased from Integrated DNA Technologies, Coralville, Iowa). Each dsDNA molecule was added at a concentration of 1 nanomolar together with the RNP. The transfection procedures for editing the target gene Lc in the maize protoplasts were otherwise identical to those described in Examples 4 and 5.

An experiment was designed similar to that described in Example 5; sequences encoded by dsDNA molecules were integrated at the site of a DSB in promoter sequence operably linked to the gene of interest (the endogenous maize Lc gene). If the dsDNA molecule contained an auxin-responsive sequence, in the presence of an exogenously provided auxin (2,4-dichlorophenoxyacetic acid) in the culture medium, expression of the gene of interest (the Lc gene) was expected to increase in cells that had the dsDNA molecule integrated into their genome, relative to that in cells that did not have the dsDNA molecule integrated into their genome. Quantitative RT-PCR was employed on three technical replicates per treatment to measure the relative expression of the Lc gene. Controls were cells that had been subjected to the transfection procedure without an RNP. Results are provided in Table 3 with Lc gene expression levels normalized to tubulin. As previously demonstrated in Example 5, integration of the 3×DR5 dsDNA sequence into the Lc promoter region resulted in very strong upregulation of Lc expression in the presence of auxin. The 16-nucleotide *Agrobacterium* ocs enhancer sequence (SEQ ID NO:341) increased expression of the Lc gene relative to the control by about 6-fold in the absence of auxin, and by about 11-fold in the presence of auxin. In spite of its considerably truncated length, the 12-nucleotide endogenous maize sequence SEQ ID NO:343 similarly increased expression of the Lc gene relative to the control by about 4-fold in the absence of auxin, and by about 6-fold in the presence of auxin. In contrast, in the absence of auxin, the 15-nucleotide endogenous maize sequence SEQ ID NO:342 did not increase expression of the Lc gene relative to the control whether or not auxin was present. These data demonstrate sequence encoded by that a dsDNA molecule only 12 base-pairs in length and including a strand with the sequence of an endogenous maize nucleotide sequence (SEQ ID NO:343), could be integrated at a DSB introduced into the 5' untranslated (promoter) region of a gene of interest (target gene) and was capable of enhancing expression of the gene of interest by several fold in a partially auxin-dependent manner

TABLE 3

| Treatment | dsDNA (SEQ ID NO:) | WITHOUT AUXIN | | WITH AUXIN | |
| --- | --- | --- | --- | --- | --- |
| | | Lc relative expression | standard deviation | Lc relative expression | standard deviation |
| No RNP | — | 1.0 | 0.05 | 1.0 | 0.7 |
| No dsDNA | — | 0.6 | 0.12 | 0.7 | 0.01 |
| 3xDR5 | 306, 307 | 0.7 | 0.25 | 20.2 | 6.2 |
| 16 nt OCS | 341 | 6.0 | 0.62 | 10.6 | 1.25 |
| 15 nt OCS | 342 | 0.5 | 0.14 | 1.8 | 0.11 |
| 12 nt OCS | 343 | 4.4 | 0.30 | 6.2 | 0.33 |

Similar genomic modification is carried out in maize whole plants or in maize plant tissues using procedures as described in Examples 31-34.

Example 9

This example illustrates a method of modulating expression of a sequence of interest in a genome, comprising introducing at least one double-strand break (DSB) into the 5' untranslated or promoter region and integrating sequence encoded by a polynucleotide (such as a double-stranded DNA, a single-stranded DNA, a single-stranded DNA/RNA hybrid, or a double-stranded DNA/RNA hybrid) donor molecule at the site of the DSB. More specifically, this non-limiting example illustrates a method to upregulate the expression level of a sequence of interest by integrating an expression-enhancing element at the site of a DSB in the 5' untranslated or promoter region of a sequence of interest, whereby the expression level of the sequence of interest is increased, relative to a reference expression level (e. g., the expression level of the sequence of interest without the expression-enhancing element integrated into the 5' untranslated or promoter region of the sequence of interest). By "expression-enhancing element" is meant at least one contiguous sequence of nucleotides that is capable of activating or increasing transcription of a gene or sequence of interest (which can be coding, non-coding, or a combination of coding and non-coding sequence). Embodiments of expression-enhancing elements include those that are located cis to the sequence of interest, and that can be located upstream (5' to) or downstream (3' of) the sequence of interest; if located upstream of the sequence of interest, an expression-enhancing element can be located within a promoter region, or outside of (even several hundred or thousand nucleotides upstream from) the promoter region. In some embodiments, the expression-enhancing element is one that provides a constitutive increase in expression levels of the sequence of interest. In other embodiments, the expression-enhancing element is one that provides a non-constitutive (e. g., tissue-specific, temporally specific, developmentally specific, inducible by or responsive to a physical influence such as light intensity or quality, day length, temperature levels, small molecules or ligands or hormones, transcription factors, water availability, or nutrient availability) change in expression levels of the sequence of interest. The expression level of the sequence of interest is estimated by any suitable technique, such as by measuring transcript abundance (e. g., by quantitative PCR) or (for sequences of interest that encode a protein) by measuring protein abundance (e. g., by Western blots). The method further provides the ability to adjust the expression of an endogenous gene or sequence of interest to a desired level under given conditions, by selecting a particular expression-enhancing element and the location of its integration upstream of (5' to) the TSS of the endogenous gene or sequence of interest. In embodiments, the degree of increase in expression level is selected by the proximity of the DSB (and of the integrated expression-enhancing element) to the transcription start site (TSS) of the sequence of interest. The more proximal the integrated expression-enhancing element is to the TSS, the greater is the increase in expression level; an expression-enhancing element integrated at locations more distal to the TSS provides a correspondingly lowered increase in expression level.

The following non-limiting example illustrates using a ribonucleoprotein (RNP) including a guide RNA (gRNA) and a nuclease to introduce a DSB in the promoter region of a protein-coding gene, integration of at least one expression-enhancing element (using a chemically modified double-stranded DNA encoding multiple copies of the auxin response element DR5) at the site of the DSB, wherein the at least one expression-enhancing element provides a non-constitutive increase in expression of the gene—in this case an increase in expression that is responsive to the presence of a hormone (auxin).

Experimental details were similar to those described in Examples 3, 4, 5, and 6. The target gene selected for editing was non-coding sequence, in this case the partial promoter sequence (sequence directly upstream of the transcription start site) of the maize (Zea mays) Lc gene (see www[dot]maizegdb[dot]org/gene_center/gene/GRMZM5G822829) with the sequence of SEQ ID NO:305; and guide RNA (crRNA) sequences were designed to edit this non-coding sequence.

Maize A188 protoplasts were prepared as described in Examples 1, 3, 4, 5, and 6. Ribonucleoproteins (RNPs) were prepared with Cas9 nuclease (Aldevron, Fargo, N. Dak.) and guide RNA complexes. Three guide RNA complexes were made with a crRNA and a tracrRNA (crRNAs and tracrRNA were purchased from Integrated DNA Technologies, Coralville, Iowa); the first guide RNA complex used a crRNA (ZmLc Pro-1) having the sequence GCUCCUCACUAGC-UACCAAGGUUUUAGAGCUAUGCU (SEQ ID NO:306); the second guide RNA complex used a crRNA (ZmLc Pro-2) having the sequence AUA-GAGAGAGAGAAAAAGAGGUUUUAGAGCUAUGCU (SEQ ID NO:344) and the third guide RNA complex used a crRNA (ZmLc Pro-3) having the sequence CUC-CAAGUGACCGAGCAAGAGUUUUAGAGCUAUGCU (SEQ ID NO:334). These guides were designed to respectively effect a DSB at 173 (ZmLc Pro-1), 272 (ZmLc Pro-3), or 415 (ZmLc Pro-2) nucleotides upstream of (5' to) the TSS of the Lc coding sequence.

The transfection procedures for editing the target gene Lc in the maize protoplasts were similar to those described in Example 3, 4, and 5. Three different expression-enhancing elements (each including a different copy number of the auxin response element DR5 having the sequence ccttttgtcgg (SEQ ID NO:308)) were integrated at the site of a DSB introduced into the Lc promoter region at one of three specific locations upstream of (5' to) the Lc TSS. The three dsDNA molecules ("3xDR5", ("6xDR5", and ("9xDR5") described in Example 5 and encoding different copy numbers of DR5 were used, with each dsDNA added together with the RNP. All dsDNA molecules were purchased from Integrated DNA Technologies, Coralville, Iowa. In all cases, each strand was phosphorylated on the 5' end and contained two phosphorothioate linkages at each terminus (i. e., the two linkages between the most distal three bases on either end of the strand). Experimental controls including no dsDNA samples (i. e., no expression-enhancing element integrated) including the RNP only (Cas9 and guide RNA complex but no dsDNA molecule), as well as controls consisting of samples treated with Cas9 nuclease only (no guide RNA, no dsDNA) and null samples (no nuclease, guide RNA, or dsDNA). As the culture medium contained an herbicide (2,4-dichlorophenoxyacetic acid) having auxin-like properties, expression of the endogenous maize Lc gene was expected to increase in cells that had any of the expression-enhancing elements integrated into the endogenous Lc promoter region, relative to that in cells that did not have an expression-enhancing element integrated into the endogenous Lc promoter region.

Quantitative RT-PCR was employed on three technical replicates per treatment to measure the relative expression of the Lc gene. Results (mean of triplicates, standard deviation) are provided in Table 4 with relative Lc gene expression levels normalized to tubulin. The data indicate that integration of the expression-enhancing elements (including multiple copies of the auxin response element DR5) upstream of (5' to) the transcription start site of the Lc gene resulted in an increased expression of the Lc transcript in the presence of an exogenously provided auxin (included in the medium); this increase was greatest for the 3xDR5 element. The degree of increase in expression was also observed to lessen as the integration location of the expression-enhancing element was moved further from (more distal to) the TSS; for example, the 3xDR5 element provided an increase in expression of 3863-fold, 2420-fold, or 1314-fold relative to the Cas9 nuclease control (no guide RNA and no dsDNA) when located at 173, 272, or 415 nucleotide positions upstream of the TSS, respectively. In combination, the data indicate that the degree of increase in expression can be optimized by selecting the type of expression-enhancing element as well as the location where the expression-enhancing element(s) is (are) integrated, relative to the location of the sequence of interest.

TABLE 4

| dsDNA | ZmLc-Pro1 (173 nt from TSS) | | ZmLc-Pro3 (272 nt from TSS) | | ZmLc-Pro2 (415 nt from TSS) | | | |
|---|---|---|---|---|---|---|---|---|
| | Relative expression | SD | Relative expression | SD | Relative expression | SD | Relative expression | SD |
| 3xDR5 | 3863 | 174 | 2420 | 41 | 1314 | 77 | — | — |
| 6xDR5 | 1479 | 75 | 1496 | 90 | 273 | 12 | — | — |
| 9xDR5 | 1031 | 28 | 823 | 9.0 | 101 | 2.8 | — | — |
| RNP only | 12.7 | 2.6 | 9.0 | 1.4 | 11.2 | 1.2 | — | — |
| Cas9 nuclease only | — | — | — | — | — | — | 1.0 | 0.25 |
| Null | — | — | — | — | — | — | 0.8 | 0.4 |

Samples from the treatments with the guide complexes ZmLc-Pro1 and ZmLc-Pro3 were subjected to next-generation sequencing analysis to quantify editing efficiency. The primers for sequencing included the forward primer having SEQ ID NO:313 and the reverse primer having SEQ ID NO:314) for an expected amplicon size of 226 base-pairs (SEQ ID NO:315). Results are provided in Table 5.

TABLE 5

| Guide RNA complex | dsDNA | Editing efficiency at 173 nt from TSS | Editing efficiency at 272 nt from TSS | dsDNA insertion efficiency |
| --- | --- | --- | --- | --- |
| ZmLc-Pro1 | 3xDR5 | 34% | 0% | 21% |
| (173 nt | 6xDR5 | 25% | 0% | 3% |
| from TSS) | 9xDR5 | 11% | 0% | 0% |
|  | none | 41% | 0% | 0% |
| ZmLc-Pro3 | 3xDR5 | 1% | 17% | 11% |
| (272 nt | 6xDR5 | 1% | 15% | 0% |
| from TSS) | 9xDR5 | 2% | 10% | 0% |
|  | RNP | 0% | 23% | 0% |
| Cas9 nuclease only | — | 9% | 0% | 5% |
| Null | — | 7% | 0% | 3% |

In a second experiment following the same general procedures described above, maize A188 protoplasts were transfected with the guide RNA complex including the "ZmLc Pro-3" crRNA (SEQ ID NO:334) complexed with a tracrRNA (Integrated DNA Technologies, Coralville, Iowa); this guide complex was designed to effect a DSB at 272 nucleotides upstream of (5' to) the TSS of the Lc coding sequence. In one set of samples, an expression-enhancing element in the form of the 34 base-pair dsDNA molecule "3xDR5" (with strands having the sequences of SEQ ID NO:306 and SEQ ID NO:307), which contains three copies of an auxin response element (SEQ ID NO:308), as described in Example 9, was integrated at this DSB. The "3xDR5" dsDNA was purchased from Integrated DNA Technologies, Coralville, Iowa; each strand was phosphorylated on the 5' end and contained two phosphorothioate linkages at each terminus (i. e., the two linkages between the most distal three bases on either end of the strand). Maize protoplasts treated with no nuclease, no guide RNA complex, and no dsDNA served as a null control. The transformed protoplasts were then incubated in a maize incubation buffer including the herbicides 2,4-dichlorophenoxyacetic acid ("2,4-D") or 3,6-dichloro-2-methoxybenzoic acid ("dicamba"), both of which have auxin-like properties, each at 1 milligram/liter, or including no herbicide as a control. Quantitative RT-PCR was employed on three technical replicates per treatment to measure the relative expression of the Lc gene. Results (mean of triplicates, standard deviation) are provided in Table 6 with relative Lc gene expression levels normalized to tubulin. The data indicate that, without any modification of the Lc promoter, or with only treatment with the RNP to effect a DSB but without integration of the 3xDR5 expression-enhancing element, no difference was seen in Lc transcript expression in the presence or absence of either herbicide. In contrast, integrating the 3xDR5 expression-enhancing element into a DSB in the promoter region of the endogenous Lc gene resulted in an over 200-fold increase in expression of the Lc transcript in the presence of either herbicide, in comparison to expression in the absence of either herbicide.

TABLE 6

| Transfection | dsDNA | Incubation medium | Relative expression | SD |
| --- | --- | --- | --- | --- |
| Null control | none | No added herbicide | 1.0 | 0.22 |
| Null control | none | 2,4-D | 1.0 | 0.14 |
| Null control | none | Dicamba | 1.0 | 0.019 |
| ZmLc-Pro3 | 3xDR5 | No added herbicide | 9.0 | 0.84 |
| ZmLc-Pro3 | 3xDR5 | 2,4-D | 290 | 31 |
| ZmLc-Pro3 | 3xDR5 | Dicamba | 236 | 47 |
| ZmLc-Pro3 | none | No added herbicide | 1.6 | 0.22 |
| ZmLc-Pro3 | none | 2,4-D | 1.5 | 0.36 |
| ZmLc-Pro3 | none | Dicamba | 1.3 | 0.11 |

A third experiment demonstrated the use of an expression-enhancing element to provide inducible upregulation of expression for a sequence of interest. Following the same general procedures described above, protoplasts were harvested from leaves of B73 maize plants that had been grown in nitrate-free medium for 13 days. The sequence of interest was an endogenous maize ammonium transporter AMT3 gene (GRMZM2G118950, see www[dot]maizegdb[dot]org/gbrowse?name=GRMZM2G118950), having a promoter sequence of (SEQ ID NO: 345)
CGATAAACGCCACTAAAAATGGTTTTACGACCGCCAGTATATATCT

TCTCTGTACTAGTGTGATACTATCAGGCCGCATGCAGATTCCTTTC

GATTGTTTATAGGGTTTTTTTTTTATAAAGACTGCTGGTTTTCAA

GCCTTGAATCTTGTAGCTAGGTAGCCAGACCGGTCCCGGCCGGGTC

GAGGAAGACGCAAAACTCAGCAAGCACAGTTGTGCTAGCCTGCTAG

GCACGGTGTGTAGCAAGAGACAGAAACGAGCGTATAACCATGGCGA

TTAACTGATAGCTGTGGAATTTTGAGCACATAGTCCTCCAAACATT

TGCATTTGTATTGTACTATTGTTTATGTAGCGAAGTTTAAAATGCA

GTTTGGTAGGCCTAACCCGCATGCGAGGGCACCGCACAGTGAGGCT

GAGGAACGGAACCACTCCAGCTAAGATTCCGCACCGCAGCAACCCT

GGGATCCTGCTGTCAGCGCGGGCCGCGGGAGGGGAGATTCACTGGC

AGCAGGGCCCCACACCCCTTCCCAGGCTTCCCATCTCAGAAAACAG

AAGCCGATCTGTTTTGTTCTGCCGAATCAAAAGTGCGATATGATCG

TCATCTCTTCGACAGCACCCGCCCAACCATCTCCTATAAATCCGAT

CGCCGCCACTGGCCGTTCGTCCCCCATC.

The nitrate-starved maize protoplasts were transfected with ribonucleoproteins (RNPs) prepared with Cas9 nuclease (Aldevron, Fargo, N. Dak.) and guide RNA complexes. Guide RNA complexes were made with three different crRNAs and a tracrRNA (all purchased from Integrated DNA Technologies, Coralville, Iowa); the first guide RNA complex used a crRNA (AMT3Pro-1) having the sequence CCAGUGAAUCUCCCCUCCCGGUUUUAGAGC-UAUGCU (SEQ ID NO:346); the second guide RNA complex used a crRNA (AMT3Pro-2) having the sequence CGUUCCUCAGCCUCACUGUGGUUUUAGAGC-UAUGCU (SEQ ID NO:347) and the third guide RNA complex used a crRNA (AMT3Pro-3) having the sequence CAGAAACGAGCGUAUAACCAGUUUUAGAGC-UAUGCU (SEQ ID NO:348). These guides were designed to respectively effect a DSB at 147 (AMT3Pro-1), 230 (AMT3Pro-2), and 382 (AMT3Pro-3) nucleotides upstream of (5' to) the TSS of the AMT3 coding sequence. An inducible expression-enhancing element based on a nitrogen responsive element from *Arabidopsis thaliana*, AtNRE, was used to design a 43 base-pair dsDNA (purchased from Integrated DNA Technologies, Coralville, Iowa) having one strand with the sequence (AAGAGATGAGCTCTT-GAGCAATGTAAAGGGTCAAGTTGTTTCT, SEQ ID NO:349), annealed to a second strand with the sequence (AGAAACAACTTGACCCTTTACATTGCT-CAAGAGCTCATCTCTT, SEQ ID NO:350); each strand was phosphorylated on the 5' end and contained two phosphorothioate linkages at each terminus (i. e., the two linkages between the most distal three bases on either end of the strand). The NRE dsDNA was integrated at the site of the DSBs introduced into the AMT3 promoter region.

After approximately 48 hours, samples of the transfected maize cells were treated with either 0.5 millimolar KNO$_3$ or 0.5 millimolar KCl, incubated for 1 hour, and then harvested for analysis. Quantitative RT-PCR was employed on three technical replicates per treatment to measure the relative expression of the AMT3 gene. Results (mean of triplicates, standard deviation) are provided in Table 7 with relative AMT3 gene expression levels normalized to tubulin. The data indicate that integrating the NRE expression-enhancing element into the promoter region of the endogenous AMT3 gene resulted in an inducible response to nitrate; in the presence of nitrate, expression of the AMT3 transcript was increased by about 25-fold, about 17-fold, or about 8-fold, where the NRE expression-enhancing element was inserted at 147, 230, or 382 nucleotides, respectively, from the TSS of the AMT3 gene. While the endogenous AMT3 gene shows moderate upregulation of expression in the presence of nitrate, integration of the NRE element into the AMT3 promoter region provided a much stronger response induced by nitrate.

TABLE 7

| crRNA | AtNRE insert | Treatment | Relative Expression | SD |
|---|---|---|---|---|
| AMT3Pro-1 | Y | KNO3 | 24.6 | 0.11 |
| AMT3Pro-2 | Y | KNO3 | 17.3 | 0.17 |
| AMT3Pro-3 | Y | KNO3 | 8.03 | 0.32 |
| AMT3Pro-1 | N | KNO3 | 7.95 | 0.26 |
| AMT3Pro-2 | N | KNO3 | 5.54 | 0.28 |
| AMT3Pro-3 | N | KNO3 | 5.49 | 0.23 |
| AMT3Pro-1 | Y | KCl | 0.94 | 0.064 |
| AMT3Pro-2 | Y | KCl | 1.03 | 0.20 |
| AMT3Pro-3 | Y | KCl | 1.29 | 0.079 |
| AMT3Pro-1 | N | KCl | 1.00 | 0.026 |
| AMT3Pro-2 | N | KCl | 1.02 | 0.25 |
| AMT3Pro-3 | N | KCl | 1.00 | 0.036 |

Similar genomic modification is carried out in maize whole plants or in maize plant tissues using procedures as described in Examples 31-34.

The data from these various experiments all indicate that the degree of increase in expression of a sequence or gene of interest can be set at a specific level by selecting the type (or copy number) of an expression-enhancing element as well as the location where the expression-enhancing element(s) is (are) integrated, relative to the location of the sequence of interest (e. g., relative to the location of the transcription start site of a sequence of interest). In these non-limiting examples, the expression-enhancing elements were selected for responsiveness to an exogenously provided stimulus (e. g., auxin or nitrate), and further control of expression can thus be achieved by controlling the amount of the stimulus provided. Other embodiments include the use of expression-enhancing elements that are responsive to other stimuli, e. g., transcription factors, signaling molecules such as salicylic acid or jasmonic acid, hormones, metal ions, small molecules or ligands, heat, temperature, and light or light quality; such expression-enhancing elements can be provided, e. g., in the form of sequences encoded by polynucleotide donor molecules (such as those described above under the heading "Polynucleotide Molecules") that are integrated at the site of one or more DSBs.

One of skill in the art would recognize that there are alternative methods for introducing DSBs into the genome (e. g., use of CRISPR nucleases other than Cas9, such as CasX, CasY, and Cpf1, zinc-finger nucleases (ZFNs), transcription activator-like effector nucleases (TAL-effector nucleases or TALENs), Argonaute proteins, or a meganuclease or engineered meganuclease) and thus similar embodiments of the approach described herein include use of any of these methods for introducing at least one DSB into a genome, and integration of at least one expression-enhancing element at the location of the at least one DSB.

Example 10

This example illustrates a method of simultaneously effecting multiple modifications in a genome (i. e., multiple modifications of at least one sequence of interest in a genome), comprising introducing at least two DSBs into a genome by one or more nucleases, and, optionally, integrating sequence encoded by at least one polynucleotide (such as a double-stranded DNA, a single-stranded DNA, a single-stranded DNA/RNA hybrid, or a double-stranded DNA/RNA hybrid) donor molecule at one or more DSBs. In embodiments, the modifications are effected in two or more sequences or genes of interest. In embodiments, individual DSBs have blunt ends, overhangs or a combination of a blunt end and an overhang. In embodiments, sequences encoded by two or more different polynucleotide donor molecules are integrated at one or more DSBs. In an embodiment, sequences encoded by at least two different polynucleotide donor molecules are integrated at different DSBs. In an embodiment, the polynucleotide donor molecule includes one or more strands containing chemically modified DNA. Embodiments include double-stranded DNA or double-stranded DNA/RNA hybrid molecules, and single-stranded DNA or single-stranded DNA/RNA hybrid donor molecules, the sequence of which in analogous procedures is integrated at the site of at least two DSBs. More specifically, this non-limiting example illustrates using multiple different ribonucleoproteins (RNPs), wherein each RNP includes a guide RNA (gRNA) and a nuclease, to effect multiple DSBs in the genome of a monocot plant, and integration of sequence encoded by a double-stranded DNA (dsDNA) at the location of the multiple DSBs. In this example, two endogenous maize (*Zea mays*) sequences or genes of interest, Lc (see Examples 5, 6, 8, and 9) and BBM2 (see Example 3), were selected for modification by insertion of an expression-enhancing element at a DSB located in the promoter region of each gene.

Maize B73 protoplasts were prepared as described in Examples 1, 3, 4, 5, 6, and 9. Ribonucleoproteins (RNPs) were prepared with Cas9 nuclease (Aldevron, Fargo, N. Dak.) and guide RNA complexes. Guide RNA complexes were made with crRNAs and a tracrRNA purchased from Integrated DNA Technologies, Coralville, Iowa. For modifying the promoter of the endogenous maize Lc gene, the crRNA "ZmLc Pro-1" (SEQ ID NO:306, see Example 5)

was used; this was designed to effect a DSB 173 nucleotides upstream of (5' to) the transcription start site (TSS) of the Lc coding sequence. For modifying the promoter of the endogenous maize BBM2 gene, the crRNA "ZmBBM2-2" (SEQ ID NO:31, see Example 3) was used; this was designed to effect a DSB 342 nucleotides upstream of (5' to) the TSS of the BBM2 coding sequence. An expression-enhancing element in the form of the 34 base-pair dsDNA molecule "3×DR5" (with strands having the sequences of SEQ ID NO:306 and SEQ ID NO:307), which contains three copies of an auxin response element (SEQ ID NO:308), as described in Example 9, was purchased from Integrated DNA Technologies, Coralville, Iowa; each strand was phosphorylated on the 5' end and contained two phosphorothioate linkages at each terminus (i. e., the two linkages between the most distal three bases on either end of the strand).

Following the same general procedures described above (e. g., Examples 3, 4, 5, 6, and 9) the protoplasts were transfected with the RNPs (including the guide RNA complexes), with or without the dsDNA molecule "3×DR5" (see Example 5). Transfections were carried out to deliver the same molar quantity of RNP for each genomic locus targeted for modification. Samples transfected with both the RNP containing the ZmLc Pro-1 guide RNA complex and the RNP containing the ZmBBM2-2 guide complex were thus transfected with twice the amount of nuclease (provided as RNP) as the samples that were transfected with only a single RNP (containing either the ZmLc Pro-1 guide RNA complex or the ZmBBM2-2 guide complex). Maize protoplasts treated with no nuclease, no guide RNA complex, and no dsDNA served as a null control. The transformed protoplasts were then incubated for about 48 hours in a maize incubation buffer including the herbicide 2,4-dichlorophenoxyacetic acid ("2,4-D"), which has auxin-like properties. Quantitative RT-PCR was employed on three technical replicates per treatment to measure the relative expression of the Lc and BBM2 genes. Results (mean of triplicates, standard deviation) are provided in Table 8 with relative Lc or BBM2 gene expression levels normalized to tubulin. The data indicate that integrating the 3×DR5 expression-enhancing element into the promoter region of either the endogenous Lc gene or the BBM2 gene resulted in an increased expression of that gene in the presence of exogenous auxin, relative to the expression of either gene lacking the promoter modification (integration of the expression-enhancing element). The data also indicate that simultaneous multiple modifications (integration of a dsDNA at a DSB in the promoter region of two different genes) in the maize protoplasts' genome was effected at about the same efficiency as a single modification, as the relative expression of the individual genes in these protoplasts was approximately the same expression level as observed for the same gene in the protoplasts that had only that one gene modified.

TABLE 8

| | | Lc | | BBM2 | |
|---|---|---|---|---|---|
| crRNA(s) | dsRNA | Relative Expression | SD | Relative Expression | SD |
| none (null control) | none | 1.01 | 0.16 | 1.01 | 0.13 |
| ZmBBM2-2 | 3xDR5 | 1.03 | 0.12 | 4.62 | 0.52 |
| ZmLc Pro-1 | 3xDR5 | 8.16 | 1.51 | 0.77 | 0.046 |
| ZmBBM2-2 and ZmLc Pro-1 | none | 1.18 | 0.14 | 0.70 | 0.064 |

TABLE 8-continued

| | | Lc | | BBM2 | |
|---|---|---|---|---|---|
| crRNA(s) | dsRNA | Relative Expression | SD | Relative Expression | SD |
| ZmBBM2-2 and ZmLc Pro-1 | 3xDR5 | 6.61 | 0.22 | 4.99 | 0.17 |

Similar genomic modification is carried out in maize whole plants or in maize plant tissues using procedures as described in Examples 31-34.

One of skill in the art would recognize that simultaneously effecting multiple DSBs in a genome (e. g., effecting multiple DSBs in a sequence of interest or effecting at least one DSB in each of two or more sequences of interest) can be achieved with alternative methods (e. g., use of CRISPR nucleases other than Cas9, such as CasX, CasY, and Cpf1, zinc-finger nucleases (ZFNs), transcription activator-like effector nucleases (TAL-effector nucleases or TALENs), Argonaute proteins, or a meganuclease or engineered meganuclease) and thus similar embodiments of the approach described herein include use of any of these methods for simultaneously effecting multiple DSBs in a genome, and, optionally, integrating at least one polynucleotide molecule at one or more DSBs.

Example 11

This example illustrates a method of changing expression of a sequence of interest in a genome, comprising integrating sequence encoded by a polynucleotide (such as a double-stranded DNA, a single-stranded DNA, a single-stranded DNA/RNA hybrid, or a double-stranded DNA/RNA hybrid) donor molecule, at the site of at least one double-strand break (DSB) in a genome. This example further demonstrates integration of sequences encoded by polynucleotide (such as a double-stranded DNA, a single-stranded DNA, a single-stranded DNA/RNA hybrid, or a double-stranded DNA/RNA hybrid) donor molecules at a DSB in genomic sequence. More specifically, this non-limiting example illustrates using a ribonucleoprotein (RNP) including a guide RNA (gRNA) and a nuclease to effect a DSB in the genome of a monocot plant, and integration of sequence encoded by a polynucleotide donor molecule including a sequence recognizable by a specific binding agent, and wherein contacting the integrated sequence encoded by the polynucleotide donor molecule with the specific binding agent results in a change of expression of a sequence of interest. In this particular example, sequence encoded by the polynucleotide is integrated at a DSB located in non-coding genomic sequence (i. e., in a promoter region), the sequence recognizable by a specific binding agent includes an enhancer element that is responsive to auxin, the specific binding agent is an auxin, and the change of expression is upregulation of the sequence of interest.

Maize B73 protoplasts were prepared as described in Examples 1, 3, 4, 5, 6, 9, and 10. Ribonucleoproteins (RNPs) were prepared with Cas9 nuclease (Aldevron, Fargo, N. Dak.) and a guide RNA complex including the "ZmLc Pro-3" crRNA (SEQ ID NO:334) complexed with a tracrRNA (Integrated DNA Technologies, Coralville, Iowa); this guide complex was designed to effect a DSB at 272 nucleotides upstream of (5' to) the TSS of the Lc coding sequence. Three polynucleotides including a sequence recognizable by a specific binding agent were tested for integration at the site of the DSB: (a) a 34 base-pair dsDNA molecule "3×DR5" (with strands having the sequences of SEQ ID NO:306 and SEQ ID NO:307), which contains three copies of an auxin response element (SEQ ID NO:308) (see Example 9); (b) a 34 nucleotide single-stranded DNA (ssDNA) molecule having the sequence 5'-ccgacaaaaggccgacaaaaggccgacaaaaggt-3' (SEQ ID NO:306) (i. e., equivalent to only a single strand of the "3×DR5" dsDNA molecule); and a 34 base-pair blunt-ended double-stranded DNA/RNA hybrid (analogous to the dsDNA molecule "3×DR5") formed by annealing a DNA strand having the sequence of and an RNA strand having the sequence of 5'-ACCUUUUGUCGGCCUUUUGUCGGCC-UUUUGUCGG-3' (SEQ ID NO:351). All polynucleotides tested for integration at the DSB were purchased from Integrated DNA Technologies, Coralville, Iowa; each DNA or RNA strand was phosphorylated on the 5' end and contained two phosphorothioate linkages at each terminus (i. e., the two linkages between the most distal three bases on either end of the strand).

Following the same general procedures described above (e. g., Examples 3, 4, 5, 6, and 9) the protoplasts were transfected with the RNPs (including the guide RNA complexes), with or without a dsDNA, ssDNA, or DNA/RNA hybrid polynucleotide for integration. Transfections were carried out to deliver the same molar quantity of polynucleotide for integration. Maize protoplasts treated with no nuclease, no guide RNA complex, and no dsDNA served as a null control. The transformed protoplasts were then incubated for about 48 hours in a maize incubation buffer including the herbicide 2,4-dichlorophenoxyacetic acid ("2, 4-D"), which has auxin-like properties. Quantitative RT-PCR was employed on three technical replicates per treatment to measure the relative expression of the Lc gene. Results (mean of triplicates, standard deviation) are provided in Table 9 with relative Lc gene expression levels normalized to tubulin.

TABLE 9

| Conditions | Lc relative expression | standard deviation |
|---|---|---|
| Null (no RNP, no polynucleotide) | 1.00 | 0.11 |
| RNP only | 2.39 | 0.19 |
| RNP + dsDNA | 61.1 | 2.71 |
| RNP + ssDNA | 107.5 | 2.28 |
| RNP + DNA/RNA hybrid | 6.79 | 0.30 |

As in previous Examples, the data indicate that integration of sequence encoded by a dsDNA including the 3×DR5 expression-enhancing element into the promoter region of the endogenous Lc gene resulted in increased expression in the presence of exogenous auxin, about sixty-fold increased expression relative to the expression of the Lc gene lacking the promoter modification (integration of an expression-enhancing element). Surprisingly, the data also indicate that integration of sequence encoded by a ssDNA polynucleotide containing the 3×DR5 expression-enhancing element appeared to provide an even greater increase in relative expression of the Lc gene in the presence of endogenous auxin, well over 100-fold increased relative expression, or nearly twice the increase in relative expression observed with that obtained with the dsDNA 3×DR5 polynucleotide. Furthermore, the data also indicate that integration of sequence encoded by a double-stranded DNA/RNA hybrid polynucleotide containing the 3×DR5 expression-enhancing element also increased relative expression of the Lc gene in the presence of endogenous auxin by at least a few fold relative to the expression of the Lc gene lacking the promoter modification (integration of an expression-enhancing element).

A second experiment to compare the effects of dsDNA and ssDNA polynucleotides was performed using essentially the same procedures as above, using maize B73 protoplasts and ribonucleoproteins (RNPs) prepared with Cas9 nuclease (Aldevron, Fargo, N. Dak.) and a guide RNA complex including the "ZmLc Pro-3" crRNA (SEQ ID NO:334) complexed with a tracrRNA (Integrated DNA Technologies, Coralville, Iowa). This experiment included longer ssDNA polynucleotides encoding the 6×DR5 or 9×DR5 sequences (see Examples 5, 6, and 9). Maize protoplasts treated with no nuclease, no guide RNA complex, and no dsDNA served as a null control. The transformed protoplasts were then incubated for about 48 hours in a maize incubation buffer including the herbicide 2,4-dichlorophenoxyacetic acid ("2, 4-D"), which has auxin-like properties. Quantitative RT-PCR was employed on three technical replicates per treatment to measure the relative expression of the Lc gene. Results (mean of triplicates, standard deviation) are provided in Table 10 with relative Lc gene expression levels normalized to tubulin. The results indicated that, in each case, the integration of sequence encoded by the ssDNA polynucleotide into the Lc promoter region resulted in greater upregulation of Lc relative expression; in this experiment, the increased upregulation of Lc expression was most marked in the 3×DR5 and 9×DR5 cases (an approximately 2-fold increase in upregulation effected by the ssDNA polynucleotides, compared to that observed with the dsDNA equivalents). This suggests that ssDNA polynucleotides are especially of use when integrating longer nucleotide sequences (e. g., of more than 100 contiguous nucleotides).

TABLE 10

| Conditions | Lc relative expression | standard deviation |
|---|---|---|
| Null | 1.00 | 0.07 |
| RNP only | 1.52 | 0.05 |
| 3xDR5, ssDNA | 61.0 | 2.6 |
| 3xDR5, dsDNA | 34.7 | 3.0 |
| 6xDR5, ssDNA | 46.8 | 1.8 |
| 6xDR5, dsDNA | 43.3 | 2.2 |
| 9XDR5, ssDNA | 19.6 | 0.6 |
| 9XDR5, dsDNA | 8.9 | 0.9 |

Similar genomic modification is carried out in maize whole plants or in maize plant tissues using procedures as described in Examples 31-34.

Example 12

This example illustrates a method of changing expression of a sequence of interest in a genome, comprising integrating sequence encoded by a polynucleotide (such as a double-stranded DNA, a single-stranded DNA, a single-stranded DNA/RNA hybrid, or a double-stranded DNA/RNA hybrid) donor molecule at the site of at least one double-strand break (DSB) in a genome. More specifically, this non-limiting example illustrates using a ribonucleoprotein (RNP) including a guide RNA (gRNA, in this case a Cpf1 crRNA without a tracrRNA) and a Cpf1 nuclease to effect a DSB in the genome of a plant, and integration of sequence encoded by a polynucleotide donor molecule including a sequence recognizable by a specific binding agent, wherein contacting the integrated sequence encoded by polynucleotide with the specific binding agent results in a change of expression of a sequence of interest. In this particular example, sequences encoded by dsDNAs either with blunt ends or with overhangs, and encoding an auxin-responsive enhancer element, were integrated at a DSB located in non-coding genomic sequence (i. e., in the promoter region of a sequence of interest); in the presence of auxin, expression of the sequence of interest was increased.

Maize B73 protoplasts were prepared as described in Examples 1, 3, 4, 5, 6, 7, 10, and 11. Ribonucleoproteins (RNPs) were prepared with Cpf1 nuclease (Aldevron, Fargo, N. Dak.) and a "Cpf1 LcPro3" crRNA with the sequence 5'-UGGACAGAGCUCCAAGUGACC-3' (SEQ ID NO:352). Two polynucleotides including a sequence recognizable by a specific binding agent were tested for integration at the site of the Cpf1-effected DSB. The first polynucleotide was a 34 base-pair blunt-ended dsDNA molecule "3xDR5" (with strands having the sequences of SEQ ID NO:306 and SEQ ID NO:307), which contains three copies of an auxin response element (SEQ ID NO:308) (see Example 9); each DNA strand was phosphorylated on the 5' end and contained two phosphorothioate linkages at each terminus (i. e., the two linkages between the most distal three bases on either end of the strand). The second polynucleotide was a "sticky-ended" dsDNA molecule with overhangs at each terminus, produced by annealing (a) a forward DNA strand having the sequence 5'-TCGGTCCGACAAAAGGCCGACAAAAGGCGGA-CAAAAGG-3' (SEQ ID NO:353) and containing four phosphorothioate linkages at the 5' end (i. e., the four linkages between the five most 5' bases of the strand) and two phosphorothioate linkages at the 3' end (i. e., the two linkages between the three most 3' bases of the strand) and (b) a reverse DNA strand having the sequence 5'-ACCGACCTTTTGTCGGCCTTTTGTCGGCCTTTTG-TCGG-3' (SEQ ID NO:354) and containing five phosphorothioate linkages at the 5' end (i. e., the five linkages between the six most 5' bases of the strand) and two phosphorothioate linkages at the 3' end (i. e., the two linkages between the three most 3' bases of the strand); each DNA strand was phosphorylated on the 5' end and. All polynucleotides tested for integration at the DSB were purchased from Integrated DNA Technologies, Coralville, Iowa.

Following the same general procedures described above (e. g., Examples 3, 4, 5, 6, 9, 10, and 11) the protoplasts were transfected with the RNPs (including the guide RNA complexes), with or without a blunt-ended or a "sticky-ended" dsDNA polynucleotide for integration. Maize protoplasts treated with no nuclease, no guide RNA complex, and no dsDNA served as a null control. The transformed protoplasts were pelleted by centrifugation at 1200 rpm, resuspended in 1 milliliter maize incubation buffer (see Example 2) including the herbicide 2,4-dichlorophenoxyacetic acid ("2,4-D") with 50 millimolar CaCl2 added), and plated in 6-well plates. The plates were incubated 1 hour at 37 degrees Celsius, and then incubated for about 48 hours at 26 degrees Celsius in the dark. Results are provided in Table 11. The data indicate that the sticky-ended dsDNA was inserted at a higher percentage than was the blunt-ended dsDNA. NGS sequencing results showed that the stick-ended dsDNA was inserted in the correct orientation to a much greater degree than was the blunt-ended dsDNA. This observation suggests that using a nuclease (such as Cpf1) that effects a double-strand break with overhangs (or, alternatively, using two nucleases to effect two DSBs between which genomic sequence is excised, wherein at least one of the nucleases effects a DSB with overhangs) results in an asymmetry at the locus for insertion of a nucleotide sequence encoded by a polynucleotide donor molecule that provides an opportunity for insertion of the nucleotide sequence in the correct orientation.

TABLE 11

| Conditions | % correct editing | % correct insertion | +Orientation (% of Insertion) |
|---|---|---|---|
| Null (no RNP, no polynucleotide) | 0 | 0 | |
| RNP only | 72 | — | |
| RNP + blunt-ended dsDNA | 72 | 9 | 38.9 |
| RNP + sticky-ended dsDNA | 68 | 15 | 97.1 |

Similar genomic modification is carried out in maize whole plants or in maize plant tissues using procedures as described in Examples 31-34.

Example 13

This example illustrates a method of providing a plant cell having a modified phenotype, the method including introducing multiple double-strand breaks (DSBs) into the genome, in this case into non-translated genomic sequence (the 5' untranslated or promoter region) of multiple genes, and integrating at the site of the DSBs a nucleotide sequence encoded by a polynucleotide (such as a double-stranded DNA, a single-stranded DNA, a single-stranded DNA/RNA hybrid, or a double-stranded DNA/RNA hybrid) donor molecule. In this non-limiting example, multiple genomic modifications ("multiplexed edits") are effected in a maize cell by using multiple ribonucleoproteins (RNPs), each including a nuclease and a guide RNA (gRNA), to introduce a DSB at a predetermined site in the promoter region of each of three different maize genes involved in nitrogen uptake and utilization, and integrating a nitrate-responsive element sequence (encoded by a chemically modified double-stranded DNA) at the site of each DSB. The effects of the resulting multiple genomic modifications include both a non-constitutive (nitrate-responsive) increase in expression of each of the three modified genes as well as an increase in expression of an unmodified gene, AMT3.

The three endogenous maize genes selected for modification were a maize transcription factor, Dof1 (see, e. g., www[dot]uniprot[dot]org/uniprot/Q1HFQ1; Kurai et al. (2001) *Plant Biotechnol. J.,* 9:826-837); a maize nitrogen transporter, NRT2.2 (see, e. g., www[dot]uniprot[dot]org/uniprot/Q53CL7); and a maize glutamine synthetase, Gln1.4 (see, e. g., www[dot]uniprot[dot]org/uniprot/B9TSW5). The nitrate-responsive maize ammonium transporter AMT3 gene (GRMZM2G118950, see www[dot] maizegdb[dot]org/gbrowse?name=GRMZM2G118950) was chosen as an unmodified read-out gene.

Maize B73 protoplasts were harvested from leaves of B73 maize plants that had been grown in nitrate-free medium for 13 days (see Example 9). Three different ribonucleoproteins (RNPs) were prepared with Cas9 nuclease (Aldevron, Fargo, N. Dak.) and one of three guide RNA complexes, each including a different crRNA complexed with a tracrRNA (Integrated DNA Technologies, Coralville, Iowa). The three crRNAs were "NRT2.2_Pro1" with the sequence CAAACAAAAAAGAAUGCAUGGUUUUAGAGC-UAUGCU (SEQ ID NO:361), "Gln1-4_Pro-1" with the sequence UGUAUCCGUAUUUAUACGUGGUUUUA-GAGCUAUGCU (SEQ ID NO:362), and "Dof1_Pro-1" with the sequence GACGCGAGUGGGGGCCCACG-GUUUUAGAGCUAUGCU (SEQ ID NO:363). A nitrogen responsive element (AtNRE, see Example 9) encoded by a polynucleotide donor molecule was provided as a 43 base-pair chemically modified dsDNA (purchased from Integrated DNA Technologies, Coralville, Iowa) having a first strand with the sequence of SEQ ID NO:349 annealed to a second strand with the sequence of SEQ ID NO:350); each strand was phosphorylated on the 5' end and contained two phosphorothioate linkages at each terminus (i. e., the two linkages between the most distal three bases on either end of the strand).

Following the same general procedures described above (e. g., Examples 3, 4, 5, 6, 9, and 11) the protoplasts were transfected with the RNPs. Maize protoplasts treated with no nuclease, no guide RNA complex, no salmon sperm DNA, and no polynucleotide donor molecule served as a null control. The different guide RNA (gRNA) complexes were prepared by mixing equal amounts of tracrRNA and the gene-specific CRISPR crRNA: 30 microliters of 100 micromolar crRNA were mixed with 30 microliters of 100 micromolar tracrRNA, heated at 95 degrees Celsius for 5 minutes, and then cooled to room temperature. To the cooled gRNA solution, 100 micrograms Cas9 nuclease (Aldevron, Fargo, N. Dak.) was added and the mixture incubated 5 minutes at room temperature to allow the ribonucleoprotein (RNP) complex to form. For three reactions, 35 microliters of an individual ("NRT2.2_Pro1", "Gln1-4_Pro-1", or "Dof1_Pro-1") RNP solution were added to 1000 microliters of maize protoplasts (prepared as described in Example 1) in a microfuge tube; in one "multiplexed editing" reaction, 35 microliters of each individual ("NRT2.2_Pro1", "Gln1-4_Pro-1", or "Dof1_Pro-1") RNP solution were added to 1000 microliters of maize protoplasts in a microfuge tube. All tubes except for the null control also received 50 microliters (50 micromolar) of the AtNRE polynucleotide donor molecule. Two microliters (20 micrograms) salmon sperm DNA (VWR Cat. No.: 95037-160) and 1.2 milliliters of 40% PEG were added to each tube. The reaction mixtures were mixed gently by tapping and incubated 5 minutes at room temperature. The reactions were stopped by adding 5 milliliters of washing buffer (0.6 molar mannitol, 4 millimolar MES pH 5.7, and 20 millimolar KCl; see Example 1) to each tube and mixed gently by inverting the tube. The tubes were centrifuged 2 minutes at 1200 rpm and the supernatant was then removed. The protoplasts were resuspended in 10 milliliters incubation solution and transferred to 10×10 cm dishes pre-coated with 5% calf serum; the dishes were sealed with Parafilm M® film (Bemis, Oshkosh, Wis.), incubated 1 hour at 37 degrees Celsius, and then incubated an additional 47 hours at 26 degrees Celsius in the dark. Forty-eight hours after transfection, half of the cells were treated with 0.5 millimolar $KNO_3$ and half with 0.5 millimolar KCl; cells were incubated 1 hour, and then harvested for analysis.

Quantitative RT-PCR was employed on three technical replicates per treatment to measure the relative expression of each gene. Results (mean of triplicates, standard deviation) are provided in Table 12 and illustrated in FIG. 2, panels A and B, with relative gene expression levels normalized to tubulin. The data indicate that, without any modifications, the Dof1, NRT2.2, and Gln1.4 genes individually responded to nitrate exposure with an increase in relative expression of about 3- to about 5-fold (Table 12; FIG. 2, panel A). Integrating a nitrogen responsive element (AtNRE) sequence into the promoter region of the Dof1, NRT2.2, and Gln1.4 strongly increased the responsiveness of these genes to nitrate; the NRE-modified genes responded to nitrate exposure with an increase in relative expression of about 12- to about 16-fold (Table 12; FIG. 2, panel A). When the Dof1, NRT2.2, and Gln1.4 genes were modified by multiplexed editing of all three genes together, the result was an additional increase in nitrate response, especially marked in NRT2.2, which responded to nitrate exposure by about 26-fold, or nearly twice the increase in expression observed when NRT2.2 was modified alone (Table 12; FIG. 2, panel A).

The relative expression of the unmodified, endogenous AMT3 gene was also measured. In cells where the Dof1, NRT2.2, and Gln1.4 genes had not been modified, AMT3 relative expression increased in the presence of nitrate by about 4-fold (Table 12; FIG. 2, panel B). In cells where the Dof1, NRT2.2, and Gln1.4 genes were individually modified, AMT3 relative expression increased in the presence of nitrate by about 12-, about 11-, and about 9-fold, respectively (Table 12; FIG. 2, panel B). In cells where the Dof1, NRT2.2, and Gln1.4 genes were modified by multiplexed editing of all three genes together, AMT3 relative expression increased in the presence of nitrate by about 25-fold (Table 12; FIG. 2, panel B).

TABLE 12

| RNP used | Gene | KCl Relative Expression | SD | $KNO_3$ Relative Expression | SD |
|---|---|---|---|---|---|
| Null control (no RNP) | Dof1 | 1.00 | 0.09 | 3.11 | 0.09 |
| | NRT2.2 | 1.00 | 0.05 | 3.76 | 0.10 |
| | Gln1.4 | 1.00 | 0.02 | 5.06 | 0.21 |
| | AMT3 | 1.01 | 0.14 | 3.72 | 0.43 |
| Dof1 | Dof1 | 0.81 | 0.04 | 16.08 | 0.28 |
| | NRT2.2 | 0.52 | 0.06 | 5.70 | 0.38 |
| | Gln1.4 | 0.86 | 0.03 | 7.24 | 0.38 |
| | AMT3 | 1.06 | 0.09 | 12.32 | 0.20 |
| NRT2.2 | Dof1 | 0.88 | 0.12 | 6.86 | 0.42 |
| | NRT2.2 | 0.83 | 0.04 | 13.28 | 0.58 |
| | Gln1.4 | 0.56 | 0.02 | 6.02 | 0.23 |
| | AMT3 | 0.50 | 0.00 | 11.25 | 0.04 |
| Gln1.4 | Dof1 | 1.21 | 0.07 | 5.67 | 0.33 |
| | NRT2.2 | 0.91 | 0.07 | 6.52 | 0.46 |
| | Gln1.4 | 0.89 | 0.02 | 12.04 | 0.11 |
| | AMT3 | 1.38 | 0.16 | 8.70 | 0.14 |
| Multiplexed edits (Dof1, NRT2.2, and Gln1.4) | Dof1 | 0.66 | 0.06 | 17.62 | 1.08 |
| | NRT2.2 | 0.49 | 0.03 | 25.74 | 2.88 |
| | Gln1.4 | 0.60 | 0.29 | 14.05 | 0.53 |
| | AMT3 | 1.12 | 0.19 | 25.01 | 2.03 |

Similar genomic modification is carried out in maize whole plants or in maize plant tissues using procedures as described in Examples 31-34 and with different nucleases (e.g., Cpf1).

Example 14

This example illustrates a method of providing a plant cell having a modified phenotype, the method including integrating at a predetermined genomic locus a nucleotide sequence encoded by a polynucleotide (such as a double-stranded DNA, a single-stranded DNA, a single-stranded DNA/RNA hybrid, or a double-stranded DNA/RNA hybrid) donor molecule. More specifically, this non-limiting example illustrates incorporation of an insulator element in the 5' untranslated or promoter region of the maize nitrate-responsive gene, AMT3.

Two different crRNAs and a tracrRNA were purchased from Integrated DNA Technologies, Coralville, Iowa. The first crRNA (AMT3-Pro1) had the sequence CCAGUGAAUCUCCCCUCCCGGUUUUAGAGC- UAUGCU (SEQ ID NO:346), and the second crRNA (AMT3-Pro2) had the sequence CGUUCCUCAGCCUCA-CUGUGGUUUUAGAGCUAUGCU (SEQ ID NO:347). Guide RNAs made with these crRNAs were designed to respectively effect a DSB at 147 (AMT3Pro-1) or 230 (AMT3Pro-2) nucleotides upstream of (5' to) the transcription start site of the AMT3 coding sequence. Guide RNA complexes were made by mixing 70 microliters of 100 micromolar tracrRNA and 70 microliters of 100 micromolar crRNA, heating the mixture to 95 degrees Celsius for 5 minutes, removing from the heating block, and allowing the tubes to cool to room temperature on the benchtop.

The palindromic nucleotide sequence of the insulator was 5'-GAATATATATATATTC-3' (SEQ ID NO:364, see U.S. Pat. No. 7,605,300, which is incorporated herein by reference) which was encoded on a chemically modified, single-stranded DNA donor molecule that was phosphorylated on the 5' end and contained two phosphorothioate linkages at each terminus (i. e., the two linkages between the most distal three bases on either end of the strand). One hundred microliters (100 micromolar) of the insulator solution was heated to 95 degrees Celsius for 5 minutes, then the heat was turned off and the solution allowed to slowly cool to room temperature in the block.

Maize B73 protoplasts were harvested from leaves of B73 maize plants that had been grown in nitrate-free medium for 13 days (see Examples 9 and 13). One milliliter of protoplasts (2×10^5 cells per milliliter) was added to each of five reaction tubes. Ribonucleoproteins (RNPs) were prepared by mixing 200 micrograms Cas9 nuclease (Aldevron, Fargo, N. Dak.) and 120 microliters of one of the two guide RNA complexes (AMT3Pro-1 crRNA/tracrRNA or AMT3Pro-2 crRNA/tracrRNA), incubating the mixtures for 5 minutes at room temperature. To each RNP solution was added 2 microliters (20 micrograms) of salmon sperm DNA (VWR Cat. No.: 95037-160). Editing experiments were carried out in the five reaction tubes with 70 microliters of an RNP solution, with or without 50 microliters of insulator solution, and sufficient buffer added if necessary to make up a total volume of 120 microliters. Maize protoplasts treated with no nuclease, no guide RNA complex, no salmon sperm DNA, and no polynucleotide donor molecule served as a null control. To each tube was added 1.2 milliliters of 40% PEG; the reaction mixtures were mixed gently by tapping and incubated 5 minutes at room temperature. The reactions were stopped by adding 5 milliliters of washing buffer (0.6 molar mannitol, 4 millimolar MES pH 5.7, and 20 millimolar KCl; see Example 1) to each tube and mixed gently by inverting the tube. The tubes were centrifuged 2 minutes at 1200 rpm and the supernatant was then removed. The protoplasts were resuspended in 6 milliliters incubation solution and transferred to 10×10 cm dishes pre-coated with 5% calf serum; the dishes were sealed with Parafilm M® film (Bemis, Oshkosh, Wis.), incubated 1 hour at 37 degrees Celsius, and then incubated an additional 47 hours at 26 degrees Celsius in the dark. Forty-eight hours after transfection, half of the plates were treated with 10 millimolar (final concentration) $KNO_3$ and half with 10 millimolar (final concentration) KCl; cells were incubated 1 hour, and then harvested for analysis.

Quantitative RT-PCR was employed on three technical replicates per treatment to measure the relative expression of the AMT3 gene. Results (mean of triplicates, standard deviation) are provided in Table 13, with relative AMT3 expression levels normalized to tubulin. The unmodified (native) maize AMT gene is responsive to high nitrate, with an increase in relative expression of about 15-fold, compared to relative expression under low nitrate conditions. Editing with only an RNP (nuclease and guide RNA complex) resulted in decreasing this response to high nitrate to about 10-fold with the AMT3-Pro1 RNP and about 12-fold with the AMT3-Pro2 RNP; this could be attributed to possible disruption of the promoter sequence and consequently possible interference with normal transcription or translation. Integration of the insulator sequence at the AMT3Pro-1-mediated DSB located 147 nucleotides upstream of the TSS of the AMT3 coding region resulted in only about 2-fold increase in relative expression under high nitrate. Integration of the insulator sequence at the AMT3Pro-2-mediated DSB located 230 nucleotides upstream of the TSS of the AMT3 coding region resulted in only about 7-fold increase in relative expression under high nitrate. Thus, integrating the relatively small insulator sequence upstream of the AMT3 TSS reduced the AMT3 gene's induction by nitrate. These results demonstrate the ability of an integrated sequence encoded by a polynucleotide donor molecule to efficiently moderate or decrease a gene's expression, for example, by "insulating" the gene's promoter from upstream enhancer sequences. This approach may also be useful, e. g., in insulating an actively transcribed gene from a epigenetically silenced gene.

TABLE 13

| | KCl | | $KNO_3$ | |
|---|---|---|---|---|
| Editing treatment | Relative Expression | SD | Relative Expression | SD |
| Null control (no RNP) | 1.00 | 0.12 | 15.55 | 1.18 |
| AMT3-Pro1 | 1.08 | 0.10 | 10.16 | 0.46 |
| AMT3-Pro1 + Insulator | 1.61 | 0.10 | 2.58 | 0.03 |
| AMT3-Pro2 | 1.69 | 0.21 | 12.33 | 0.60 |
| AMT3-Pro2 + Insulator | 1.71 | 0.06 | 7.15 | 0.26 |

Similar genomic modification is carried out in maize whole plants or in maize plant tissues using procedures as described in Examples 31-34.

Example 15

This example illustrates a method of providing a plant cell having a modified phenotype, the method including effecting a double-strand break (DSB) at a predetermined genomic locus. More specifically, this non-limiting example illustrates effecting a double-strand break (DSB) at one or at multiple predetermined loci within a first gene (FEA3), thereby reducing that gene's expression; this further results in increasing expression of a second gene (WUS), which is normally repressed by the first gene.

The transcription factor WUSCHL (WUS) is expressed in the organizing center cells below the stem cells in a plant's shoot meristem; WUS expression prevents differentiation of stem cells. WUS activates expression of CLAVATA (CLV) and the CLV signaling pathway, which then controls stem cell proliferation and differentiation. The balance between WUS and CLV is maintained by feedback signaling between the organizing center cells and stem cells. The CLV3 peptide is secreted from stem cells at the tip of the shoot apical meristem, and is bound by CLV1, is a leucine-rich-repeat (LRR) receptor kinase; this results in negative regulation of shoot and floral meristem. Another LRR receptor reported to respond to the CLV3 peptide is FASCIATED EAR3 (FEA3); weak alleles of fea3 have been reported to enhance yield in hybrid maize; see: Je et al. (2016) *Nature Genetics*, 48:785-

791; DOI: 10.1038/ng.3567. Reducing expression of FEA3 is predicted to increase expression of WUS.

These experiments were carried out to observe the effects of down-regulating or knocking-out expression of FEA3 in maize cells. Two different crRNAs and a tracrRNA were purchased from Integrated DNA Technologies, Coralville, Iowa. The first crRNA (ZmFea3-1) had the sequence GCG-CUCCUUCUCCUCCAUGGGUUUUAGAGCUAUGCU (SEQ ID NO:365), and the second crRNA (ZmFea3-2) had the sequence CCUCGGCGUGGCGCUCUCGGGUUUUA-GAGCUAUGCU (SEQ ID NO:366). Guide RNA complexes were made by mixing 60 microliters of 100 micromolar tracrRNA and 60 microliters of 100 micromolar crRNA, heating the mixture to 95 degrees Celsius for 5 minutes, removing from the heating block, and allowing the tubes to cool to room temperature on the benchtop.

Maize B73 protoplasts were harvested from leaves of B73 maize plants. One milliliter of protoplasts ($2\times10^5$ cells per milliliter) was added to each of four reaction tubes. Ribonucleoproteins (RNPs) were prepared by mixing 24 microliters (240 micrograms) Cas9 nuclease (Aldevron, Fargo, N. Dak.) and 120 microliters of one of the two guide RNA complexes (AMT3Pro-1 crRNA/tracrRNA or AMT3Pro-2 crRNA/tracrRNA), incubating the mixtures for 5 minutes at room temperature. Editing experiments were carried out in the four reaction tubes with either 72 microliters of one of the two RNP solutions or 72 microliters of both RNP solutions, with sufficient buffer added if necessary to make up a total volume of 144 microliters; 2 microliters (20 micrograms) of salmon sperm DNA (VWR Cat. No.: 95037-160) was added to each tube except for the null control. Maize protoplasts treated with no nuclease, no guide RNA complex, no salmon sperm DNA, and no polynucleotide donor molecule served as a null control. To each tube was added 1.2 milliliters of 40% PEG; the reaction mixtures were mixed gently by tapping and incubated 5 minutes at room temperature. The reactions were stopped by adding 5 milliliters of washing buffer (0.6 molar mannitol, 4 millimolar MES pH 5.7, and 20 millimolar KCl) to each tube and mixed gently by inverting the tube. The tubes were centrifuged 2 minutes at 1200 rpm and the supernatant was then removed. The protoplasts were resuspended in 4 milliliters incubation buffer (see Example 2) including the herbicide 2,4-dichlorophenoxyacetic acid ("2,4-D") with 50 millimolar $CaCl_2$ added) solution. One milliliter of cells from each tube was transferred to a well in a 6-well plate; the remaining 3 milliliters of cells from each tube were plated in four 10×10 cm dishes (all pre-coated with 5% calf serum), with another 3 milliliters of incubation buffer added per dish (for an optimal cell density for incubation). The plate and dishes were sealed with Parafilm M® film (Bemis, Oshkosh, Wis.), incubated 1 hour at 37 degrees Celsius, and then incubated an additional 47 hours at 26 degrees Celsius in the dark. Forty-eight hours after transfection, cells were harvested for analysis.

Quantitative RT-PCR was employed on three technical replicates per treatment to measure the relative expression of the FEA3 and WUS1 genes. Results (mean of triplicates, standard deviation) are provided in Table 14, with relative gene expression levels normalized to tubulin. The data show that use of a single RNP (i.e., providing a DSB at a single precise locus in the FEA3 gene), either Fea3-1 or Fea3-2, was sufficient to knock down FEA3 expression by about two-thirds; this further resulted in about a 2-fold increase in WUS expression. Use of both RNPs (i.e., providing a DSB at two precise loci in the FEA3 gene) knocked down FEA3 expression by about four-fifths, and further resulted in strong (about 15-fold) upregulation of WUS expression.

TABLE 14

| Treatment | FEA3 | | WUS | |
| --- | --- | --- | --- | --- |
| | Relative expression | SD | Relative expression | SD |
| Null control | 1.00 | 0.04 | 1.00 | 0.09 |
| Fea3-1 | 0.27 | 0.03 | 2.81 | 0.24 |
| Fea3-2 | 0.31 | 0.02 | 2.10 | 0.20 |
| Fea3 1 + 2 | 0.19 | 0.01 | 15.15 | 2.01 |

Similar genomic modification is carried out in maize whole plants or in maize plant tissues using procedures as described in Examples 31-34.

Example 16

This example illustrates a method of providing a plant cell having a modified phenotype, the method including introducing double-strand breaks (DSBs) into multiple loci or into multiple genes, and integrating at the DSBs at least two different nucleotide sequences encoded by a polynucleotide (such as a double-stranded DNA, a single-stranded DNA, a single-stranded DNA/RNA hybrid, or a double-stranded DNA/RNA hybrid) donor molecule. In this non-limiting example, multiple genomic modifications ("multiplexed edits") were effected in a maize cell by using multiple ribonucleoproteins (RNPs), each including a nuclease and a guide RNA (gRNA), to introduce a DSB at a predetermined site in the promoter region of each of two different maize genes involved in nitrogen uptake and utilization; a nitrate-responsive element sequence is then integrated at the site of the DSB in the first gene (AMT3), and a palindromic 12-nucleotide endogenous maize sequence having homology to the bacterial OCS enhancer is integrated at the site of the DSB in the second gene (Lc). In this example, a first round of editing to effect a first DSB and integration of a sequence encoded by a first polynucleotide donor molecule was carried out, followed by a second round of editing to effect a second DSB and integration of a sequence encoded by a second polynucleotide donor molecule; no selection or screening was performed between the editing rounds. The time between editing rounds was 3 hours or 18 hours.

Two crRNAs, a tracrRNA, and the polynucleotide donor molecules were purchased from Integrated DNA Technologies, Coralville, Iowa. The first crRNA (AMT3-Pro1) had the sequence of SEQ ID NO:346 (see Example 14) and the second crRNA (ZmLc-Pro3) had the sequence of SEQ ID NO:334 (see Example 9). The first polynucleotide donor molecule was a nitrogen responsive element (AtNRE, see Examples 9 and 13) encoded by a 43 base-pair chemically modified dsDNA having a first strand with the sequence of SEQ ID NO:349 annealed to a second strand with the sequence of SEQ ID NO:350, and the second polynucleotide donor molecule was the maize OCS homologue (see Example 8) encoded by a chemically modified single-stranded DNA with the sequence of SEQ ID NO:343. For both polynucleotide donor molecules, whether dsDNA or ssDNA, each strand was phosphorylated on the 5' end and contained two phosphorothioate linkages at each terminus (i.e., the two linkages between the most distal three bases on either end of the strand). Individual guide RNA complexes were made by mixing 60 microliters of 100 micromolar tracrRNA and 60 microliters of the 100 micromolar crRNA (AMT3-Pro1 or ZmLc-Pro3), heating the mixture to 95 degrees Celsius for 5 minutes, removing from the heating block, and allowing the tubes to cool to room temperature on the benchtop. To prepare the donor polynucleotide molecules, 150 microliters (100 micromolar) of the first AtNRE strand (SEQ ID NO:349) and 150 microliters (100 micromolar) of the second AtNRE strand (SEQ ID NO:350) were mixed together in a tube; to another tube was added 150 microliters (100 micromolar) of the palindromic OCS homologue ssDNA (SEQ ID NO:343). The tubes were heated to 95 degrees Celsius for 5 minutes, then the heat was turned off and the solution allowed to slowly cool to room temperature in the block.

Maize B73 protoplasts were harvested from leaves of B73 maize plants that had been grown in nitrate-free medium for 13 days (see Examples 9, 13, and 14). The protoplasts underwent a first editing reaction to integrate a nitrogen-responsive element sequence in the promoter region of the AMT3 gene, and then underwent a second editing reaction to integrate an auxin-responsive element in the promoter region of the Lc gene. Maize protoplasts treated with no nuclease, no guide RNA complex, no salmon sperm DNA, and no polynucleotide donor molecule served as a null control. One milliliter of protoplasts (2×10^5 cells per milliliter) was added to each of six reaction tubes. Then, to each of four tubes were added 5 microliters (50 micrograms) Cas9 nuclease (Aldevron, Fargo, N. Dak.) and 30 microliters of the AMT3-Pro1 guide RNA complex (AMT3-Pro1 crRNA/tracrRNA), and to the remaining two tubes (null controls) were added 90 microliters buffer. All tubes were incubated 5 minutes at room temperature. To each of the first four tubes (treated with the Cas9/AMT3-Pro1 guide RNA) were added 50 microliters of the AtNRE polynucleotide donor solution and 2 microliters (20 micrograms) salmon sperm DNA (VWR Cat. No.: 95037-160). To each tube was added 1.1 milliliters of 40% PEG; the reaction mixtures were mixed gently by tapping and incubated 5 minutes at room temperature. The reactions were stopped by adding 5 milliliters of washing buffer (0.6 molar mannitol, 4 millimolar MES pH 5.7, and 20 millimolar KCl) to each tube and mixed gently by inverting the tube. The tubes were centrifuged 2 minutes at 1200 rpm and the supernatant was then removed. The protoplasts were resuspended in 5 milliliters incubation solution (see Example 2, but without any nitrate and with 50 millimolar CaCl$_2$ added) and transferred to 10×10 cm dishes pre-coated with 5% calf serum; the dishes were sealed with Parafilm M® film (Bemis, Oshkosh, Wis.), incubated 30 minutes at 37 degrees Celsius, and then incubated at 26 degrees Celsius in the dark.

After 3 hours incubation at 26 degrees Celsius, two of the plates containing protoplasts treated with the Cas9/AMT3-Pro1 guide RNA and AtNRE polynucleotide donor molecule were subjected to the second editing reaction as follows. Ten microliters (100 micrograms) Cas9 and 60 microliters of the ZmLc-Pro3 guide RNA were mixed gently in a tube and incubated 5 minutes at room temperature; 50 microliters of the palindromic OCS homologue ssDNA (SEQ ID NO:343) solution and 2 microliters (20 micrograms) salmon sperm DNA (VWR Cat. No.: 95037-160) were then added and mixed gently in the tube. Two of the plates containing protoplasts treated with the Cas9/AMT3-Pro1 guide RNA and AtNRE polynucleotide donor molecule were harvested by centrifugation 2 minutes at 1200 rpm and the supernatant removed. The protoplasts from an individual plate were resuspended in two tubes each containing 1 milliliter washing buffer. Each tube received half of the prepared RNP (Cas9/ZmLc-Pro3)/OCS ssDNA/salmon sperm DNA mixture, and tapped gently to mix. To each tube was added 1.1 milliliters of 40% PEG; the reaction mixtures were mixed gently by tapping and incubated 5 minutes at room temperature. The reactions were stopped by adding 5 milliliters of washing buffer to each tube and mixed gently by inverting the tube. The tubes were centrifuged 2 minutes at 1200 rpm and the supernatant was then removed. The protoplasts were resuspended in 5 milliliters incubation solution (see Example 2, but without any nitrate and with 50 millimolar CaCl$_2$ added) and transferred to 10×10 cm dishes pre-coated with 5% calf serum; the dishes were sealed with Parafilm M® film (Bemis, Oshkosh, Wis.), incubated 30 minutes at 37 degrees Celsius, and then incubated at 26 degrees Celsius in the dark.

After 18 hours incubation at 26 degrees Celsius, the remaining two of the plates containing protoplasts treated with the Cas9/AMT3-Pro1 guide RNA and AtNRE polynucleotide donor molecule were subjected in a similar manner to the second editing reaction. All treatment steps were identical to those carried out at the 3-hour timepoint as described in the immediately preceding paragraph.

Twenty-four additional hours after the 18-hour transfection (editing reaction), half of the plates were treated with 0.5 millimolar KNO$_3$ and half with 0.5 millimolar KCl; cells were incubated 1 hour, and then harvested for analysis.

Quantitative RT-PCR was employed on three technical replicates per treatment to measure the relative expression of the AMT3 and Lc genes. Results (mean of triplicates, standard deviation) are provided in Table 15 and illustrated in FIG. 3, with relative gene expression levels normalized to tubulin. The data show that the endogenous (non-edited) AMT3 and Lc genes both show a moderate (about 4- to 5-fold, relative to KCl controls), nitrate-induced increase in expression. In the cells that underwent a second (ZmLc-Pro3/OCS homologue) transfection or editing reaction 3 hours after the first (AMT3-Pro1/AtNRE) transfection, there is a nitrate-induced increase in Lc expression that may be due to excess AtNRE polynucleotide donor, resulting in the AtNRE sequence being incorporated into the DSB effected by the later-provided Lc-Pro3 guide. In the cells that underwent a second (ZmLc-Pro3/OCS homologue) transfection or editing reaction 18 hours after the first (AMT3-Pro1/AtNRE) transfection, nitrate-induced increase is not observed in Lc expression, indicating that excess AtNRE polynucleotide has degraded and that it is the sequence encoded by the OCS homologue that is incorporated into the DSB effected by the Lc-Pro3 guide. There is increased relative expression of AMT3 even in the absence of nitrate induction, which suggests the possibility of some Cas9 remaining bound to the AMT3-Pro1 site at the time of the second (ZmLc-Pro3/OCS homologue) editing reaction, which might have resulted in unintentional incorporation of some OCS homologue sequence into the AMT3-Pro1 site; this effect is more evident at 3 hours than at 18 hours, indicating that there is less Cas9 remaining bound to the AMT3-Pro1 at 18 hours than at 3 hours. NGS sequencing is performed to verify and quantify correct integration of the polynucleotide donor molecules at the intended loci in the genome.

TABLE 15

| Genome editing treatment | Nutrient treatment | AMT3 | | Lc | |
|---|---|---|---|---|---|
| | | Relative Expression | SD | Relative Expression | SD |
| Null | KCl | 1.02 | 0.25 | 1.00 | 0.10 |
| | KNO₃ | 3.76 | 0.17 | 5.10 | 1.06 |
| AMT3-Pro1 + AtRNE; at 3 hours Lc-Pro3 +OCS | KCl | 5.74 | 0.30 | 17.66 | 1.00 |
| | KNO₃ | 14.45 | 1.18 | 23.67 | 0.98 |
| AMT3-Pro1 + AtRNE; at 18 hours Lc-Pro3 + OCS | KCl | 3.37 | 0.06 | 20.34 | 1.51 |
| | KNO₃ | 15.22 | 1.97 | 20.04 | 0.51 |

Similar genomic modification is carried out in maize whole plants or in maize plant tissues using procedures as described in Examples 31-34.

One of skill in the art would recognize that effecting multiple DSBs in a genome (e. g., effecting multiple DSBs in a sequence of interest or effecting at least one DSB in each of two or more sequences of interest) can be achieved by successive rounds of editing reactions in the same plant cell (or whole plant, plant part or tissue, embryo, or seed) in a manner such as that illustrated by this example. Any of these DSBs can be effected through alternative methods (e. g., use of CRISPR nucleases other than Cas9, such as CasX, CasY, and Cpf1, zinc-finger nucleases (ZFNs), transcription activator-like effector nucleases (TAL-effector nucleases or TALENs), Argonaute proteins, or a meganuclease or engineered meganuclease) and thus similar embodiments of the approach described herein include use of any of these methods and effector molecules for simultaneously effecting multiple DSBs in a genome, and, optionally, integrating at least one polynucleotide molecule at one or more DSBs.

Example 17

This example illustrates a method of modifying a sequence of interest in a genome, comprising integrating a polynucleotide (such as a double-stranded DNA, a single-stranded DNA, a single-stranded DNA/RNA hybrid, or a double-stranded DNA/RNA hybrid) molecule at the site of at least one double-strand break (DSB) in a genome. More specifically, this example illustrates integrating a sequence encoded by a polynucleotide into one or more double-strand breaks in a genome, wherein at least one of the DSBs is asymmetric (e. g., has at least a one-nucleotide overhang), and wherein the sequence encoded by the polynucleotide is integrated at the asymmetric DSB in a specific orientation. This approach is useful for integrating a specifically oriented recombinase recognition site sequence at each of two DSBs effected in a genome, allowing use of a sequence-specific recombinase to mediate deletion, exchange, inversion, or translocation of genomic sequence flanked by the recombinase recognition sites thus integrated.

In this example, the nuclease Cpf1 is used to effect a DSB containing overhangs at two loci in a genome, for example, in each of the two introns flanking an exon. A first recombinase recognition site sequence is integrated into one DSB and a second recombinase recognition site sequence is integrated into the other DSB; the two recombinase recognition site sequences are heterospecific relative to each other, i. e., each will not recombine together but each will recombine only with another recombination site of its own type. Subsequent to the genomic integration of the heterospecific recombinase recognition site sequences, a polynucleotide donor molecule is provided for recombinase-mediated genomic sequence replacement, for example, replacement of an exon. This polynucleotide donor molecule includes a replacement genomic sequence (for example, a replacement exon sequence) and further includes on each terminus a recombinase recognition site sequence that is homospecific to (i. e., will recombine with) one of the genomically integrated recombinase recognition site sequences. The appropriate recombinase is also provided, resulting in the exchange of the endogenous exon sequence for the replacement exon sequence. This technique avoids introducing editing inaccuracies such as unintentional nucleotide changes, deletions, or additions in the integrated replacement exon sequence or the messenger RNA encoded by the replacement exon. In the particular example described below, this technique is used to replace a "wild-type" maize EPSPS exon 2 (an exon having unmodified, native genomic sequence) with a replacement exon 2 sequence that encodes a modified EPSPS protein having resistance to glyphosate.

The target gene selected for editing is the maize (*Zea mays*, B73 line) enolpyruvylshikimate phosphate synthase1 (EPSPS) gene (see www[dot]maizegdb[dot]org/gene_center/gene/Zm00001d045450) with the partial genomic sequence of (SEQ ID NO: 367)
gtgaacaaccttatgaaatttgggcgcaaagaactcgccctcaagg gttgatcttatgccatcgtcatgataaacagtggagcacggacgat cctttacgttgttttttaacaaactttgtcagaaaactagcatcatt aacttcttaatgacgatttcacaacaaaaaaaggtaacctcgctac taacataacaaaatacttgttgcttattaattatatgtttttttaat ctttgatcAGGGGACAACAGTGGTTGATAACCTGTTGAACAGTGAG

GATGTCCACTACATGCTCGGGGCCTTGAGGACTCTTGGTCTCTCTG

TCGAAGCGGACAAAGCTGCCAAAAGAGCTGTAGTTGTTGGCTGTGG

TGGAAAGTTCCCAGTTGAGGATTCTAAAGAGGAAGTGCAGCTCTTC

TTGGGGAATGCTGGAACTGCAATGCGGCCATTGACAGCAGCTGTTA

CTGCTGCTGGTGGAAATGCAACgtatgtttcctctctttctctcta caatacttgctggagttagtatgaaacccatgggtatgtctagt;

a first intronic sequence (nucleotides 1-238 of SEQ ID NO:367) and a second intronic sequence (nucleotides 483-550 of SEQ ID NO:367) are given in lower-case font, exonic sequence (nucleotides 239-482 of SEQ ID NO:367) is given in upper-case font, a first crRNA (guide RNA) target site sequence (nucleotides 23-43 of SEQ ID NO:367) and a second crRNA (guide RNA) target site sequence (nucleotides 508-528 of SEQ ID NO:367) are italicized and the PAM sites (nucleotides 19-22 and nucleotides 529-532 of SEQ ID NO:367) are underlined.

Maize B73 protoplasts are prepared as described in Examples 1, 3, 4, 5, 6, 9, 10, and 11. Ribonucleoproteins (RNPs) are prepared with Cpf1 nuclease (Aldevron, Fargo, N. Dak.) and either of two guide RNAs (purchased from Integrated DNA Technologies, Coralville, Iowa); the first guide RNA ("EPS-Cpf1-g1") has the sequence UAAUUUCUACUCUUGUAGAUGGCGCAAAGAACUCGCCCUCA (SEQ ID NO:368) and the second guide RNA ("EPS-Cpf1-g2") has the sequence UAAUUUCUACUCUUGUAGAUAUACUAACUCCAGCAAGUAUU (SEQ ID NO:369).

Two different, chemically modified, double-stranded DNA (dsDNA) donor molecules, each encoding one of a pair of heterospecific recombinase recognition site sequences (in this case, loxP and lox2272), are used in this experiment. The first dsDNA ("loxP") donor molecule, containing 40 base pairs and 5-nucleotide overhangs, is produced by annealing a first strand having the sequence 5'-P-T*C*AAGGGT ATAACTTCGTATAGCATACATTATACGAAGTTATTCA-3' (SEQ ID NO:370) and a second strand having the sequence 5'-P-C*T*TGATGA ATAACTTCGTATAATGTATGCTATACGAAGTTATACC-3' (SEQ ID NO:371); the loxP sequences are underlined. The second dsDNA ("lox2272") donor molecule, containing 40 base pairs and 5-nucleotide overhangs, is produced by annealing a first strand having the sequence 5'-P-A*C*AATGGT ATAACTTCGTATAAAGTATCCTATACGAAGTTATTC-A-3' (SEQ ID NO:372) and a second strand having the sequence 5'-P-A*T*TGTTGA ATAACTTCGTATAGgATACtTTATACGAAGTTATACC-3' (SEQ ID NO:373); the lox2272 sequences are underlined.

This polynucleotide molecule including a replacement genomic sequence (for example, a replacement exon sequence) and further includes on each terminus a recombinase recognition site sequence that is homospecific to (i.e., will recombine with) one of the genomically integrated recombinase recognition site sequences.

A dsDNA molecule, including a replacement EPSPS exon sequence and further including a loxP recombinase recognition sequence 5' to the EPSPS exon sequence and a lox2272 recombinase recognition sequence 3' to the EPSPS exon sequence, was prepared by PCR using primers and a template purchased from Integrated DNA Technologies, Coralville, Iowa. The primers were had the sequences 5'-P-G*T*GAACAACCTTATGAAATTTGGG (forward primer, SEQ ID NO:374) and 5'-P-A*C*TAGACATACCCATGGGTTTCAT (reverse primer, SEQ ID NO:375), where P represents a 5' phosphorylation and * indicates a phosphorothioate linkage. The template sequence is given by 5'-GTGAACAACCTTATGAAATTTGGGCGCATAACTTCGTATAGCATACATTATACGAAGTTATAAAGAACTCGCCCTCAAGGGTTGATCTTATGC-CATCGTCATGATAAACAGTGGAGCACGGACGATCCTTTACGTTGTTTT-TAACAAACTTTGTCAGAAAACTAGCATCAT-TAACTTCTTAATGACG ATTT-CACAACAAAAAAGGTAACCTCGCTACTAACATA-ACAAAATACTTGTTGCTTATTAAT TATATGTTTTT-TAATCTTTGATCAGGGGACAACAGTGGTTGA-TAACCTGTTGAACAGTGAGG ATGTCCACTA-CATGCTCGGGGCCTTGAGGACTCTTGGTCTCTCT-GTCGAAGCGGACAAAGCTGCCAAAAGAGCTGTAGTTGTTGGCTGTGGTG-GAAAGTTCCCAGTTGAGGATTCTAAAGAGGAAGTGCAGCTCTTCTTGGGGAATGCTGGAAT-TGCAATGCGGGCATTGACAGCAGCTGTTACTGCTGCTGGTG-GAAATGCAACGTATGTTTCCTCTCTTTCTCTCTA-CAATACTTGCATAACTTCGTATAAAGTATCCTATACGAAGTTATTG-GAGTTAGTATGAAACCCATGGGTATGTCTAGT-3' (SEQ ID NO:376); this contains a loxP recombinase site sequence at positions 28-61 (underlined) of SEQ ID NO:376 and a lox2272 recombinase site sequence at positions 551-584 (underlined) of SEQ ID NO:376, and further contains nucleotide changes (relative to the wild-type sequence) at positions 465 and 476 of SEQ ID NO:376 to provide the amino acid mutations T102I and P106A in the mature protein, which are point mutations found in glyphosate-resistant EPSPS; see also Example 7.

A plant-codon-optimized Cre recombinase sequence was synthesized (Integrated DNA Technologies, Coralville, Iowa). The Cre recombinase sequence was cloned into a vector including a heat shock-inducible promoter for driving the expression of Cre. Alternatively, Cre protein is delivered directly into the cells. A Cre fusion protein useful for this recombinase reaction is a recombinant cell-permeant fusion including Cre-recombinase and a TAT sequence (a nuclear localization sequence, NLS); see, e. g., Millipore Sigma catalogue number SCR508 (EMD Millipore Corporation, Billerica, Mass.).

The maize protoplasts were subjected to a first editing reaction to integrate a loxP recombinase site sequence in the first intronic region of the EPSPS sequence given by SEQ ID NO:367, followed by a second editing reaction to integrate a lox2272 recombinase site sequence in the first intronic region of the EPSPS sequence given by SEQ ID NO:367. Maize protoplasts treated with no nuclease, no guide RNA complex, no salmon sperm DNA, and no polynucleotide donor molecule served as a null control. The multiplexed editing steps were carried out essentially as described in Example 16, with the second editing reaction carried out 18 hours after the first editing reaction; each editing reaction was followed with an initial incubation at 37 degrees Celsius (30 minutes) and then with an extended incubation room temperature (7 hours to overnight). In a final step, the protoplasts were subjected to a Cre recombinase-mediated recombination reaction in which a replacement EPSPS exon sequence replaced the endogenous EPSPS exon sequence, guided by the respective pairing of the homospecific loxP and homospecific lox2272 recombinase recognition site sequence pairs. The protoplasts were subjected to PEG-mediated transfection with the dsDNA molecule including a replacement EPSPS exon sequence (provided, e.g., as a circular plasmid or as linearized dsDNA) and with the plant-codon-optimized Cre recombinase provided as the recombinase protein (alternatively, this can be provided via an expression vector, although initial experiments indicated greater efficiency when the recombinase was provided as the protein). The Cre-treated protoplasts were transferred to plates pre-coated with 5% calf serum and containing YPIM B-liquid medium containing 50 millimolar calcium chloride, and incubated at 26 degrees Celsius. Seventy-two additional hours after the Cre-mediated recombination reaction, cells were harvested for analysis and the genomic DNA subjected to two-step PCR amplification; editing events were analyzed by Amplicon-seq, using an EC2 forward primer with the sequence AGCACGGACGATCCTTTACG (SEQ ID NO:1021) and an EC2 reverse primer with the sequence AGCTGCTTCAATCCGACAACC (SEQ ID NO:1022) to amplify the region (SEQ ID NO: 1023)
AGCACGGACGATCCTTTACGTTGTTTTTAACAAACTTTGTCAGAAA

ACTAGCATCATTAACTTCTTAATGACGATTTCACAACAAAAAAGG

TAACCTCGCTACTAACATAACAAAATACTTGTTGCTTATTAATTAT

ATGTTTTTAATCTTTGATCAGGGGACAACAGTGGTTGATAACCTG

-continued

```
TTGAACAGTGAGGATGTCCACTACATGCTCGGGGCCTTGAGGACTC

TTGGTCTCTCTGTCGAAGCGGACAAAGCTGCCAAAAGAGCTGTAGT

TGTTGGCTGTGGTGGAAAGTTCCCAGTTGAGGATTCTAAAGAGGAA

GTGCAGCTCTTCTTGGGGAATGCTGGAACTGCAATGCGGCCATTGA

CAGCAGCTGTTACTGCTGCTGGTGGAAATGCAACGTATGTTCCTC

TCTTTCTCTCTACAATACTTGCTGGAGTTAGTATGAAACCCATGGG

TATGTCTAGTGGCTTATGGTGTATTGGTTTTTGAACTTCAGTTACG

TGCTTGATGGAGTACCAAGAATGAGGGAGAGACCCATTGGCGACTT

GGTTGTCGGATTGAAGCAGCT.
```

Amplicon-seq results were analyzed by CrispRVariants (publicly available at bioconductor[dot]org/packages/release/bioc/html/CrispRVariants[dot]html). The results showed that 2.77% of the total reads contained the expected nucleotide sequence changes (i.e., nucleotide changes relative to the wild-type sequence at positions 465 and 476 of SEQ ID NO:376). Thus, in this experiment, a replacement EPSPS exon sequence encoding the amino acid mutations T1021 and P106A (as found in the mature glyphosate-resistant EPSPS protein) correctly replaced the endogenous EPSPS exon sequence in almost 3% of the maize cells.

Similar genomic modification is carried out in maize whole plants or in maize plant tissues using procedures as described in Examples 31-34.

One of skill in the art would recognize that there are many other possible applications of this approach, which combines (a) integrating at least one recombinase recognition site sequence encoded by a polynucleotide donor molecule at one or more DSBs effected by a sequence-specific nuclease, and (b) treatment with a recombinase, and optionally with a polynucleotide molecule that includes at least one recombinase recognition site sequence. Various combinations of homospecific and heterospecific recombinase recognition sites and recombinases can be used. The genomic outcome of such applications include recombinase-mediated deletion, exchange, inversion, or translocation of genomic sequence. Any of these approaches can be combined with other editing techniques. For example, the edited herbicide-tolerant EPSPS enzyme provided by the methods described in this Example can be combined with integration at a DSB effected in the 3' untranslated region of the edited herbicide-tolerant EPSPS gene of at least one recognition site sequence for an siRNA or a miRNA specifically expressed in male reproductive tissue or female reproductive tissue (e. g., the miRNAs disclosed in Table 6 of U.S. Pat. No. 8,334,430 or the siRNAs disclosed in U.S. Pat. No. 9,139,838, both incorporated herein by reference); this results in expression of the edited herbicide-tolerant enzyme being restricted to tissues other than those in which the siRNA or miRNA is endogenously expressed, and those tissues in which the siRNA or miRNA is expressed will not be resistant to herbicide application; this approach is useful, e. g., to provide male-sterile or female-sterile plants. Although the details provided here are specific to Cre recombinase and loxP (and lox variant) sites, the methods and compositions described herein are generally applicable to other recombinases and their corresponding recombinase recognition site sequences, such as, but not limited to, FLP recombinase and frt recombinase recognition site sequences, R recombinase and Rs recombinase recognition site sequences, Dre recombinase and rox recombinase recognition site sequences, and Gin recombinase and gix recombinase recognition site sequences.

Example 18

This example describes the modification of three genes in a maize plant cell to provide increased nitrogen use efficiency (NUE).

Maize protoplasts are prepared as described in Example 1. Preparation of reagents, gene editing procedures, and detection of gene modifications are carried out using procedures similar to those described in Examples 13-16.

An increase in expression of NRT2.2 (Zm00001d054060) is predicted to increase nitrogen use efficiency. A partial genomic sequence of NRT2.2 is provided as SEQ ID NO:381. A nitrogen responsive element sequence encoded by a polynucleotide (such as a double-stranded DNA, a single-stranded DNA, a single-stranded DNA/RNA hybrid, or a double-stranded DNA/RNA hybrid) is inserted upstream of the transcription start site (TSS) of the NRT2.2 coding region at a double-strand break effected between nucleotides at positions 101/102 of SEQ ID NO:381 in order to enhance the expression of NRT2.2. The nitrogen responsive element (AtNRE, see Examples 9, 13, and 16) is encoded by a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i. e., the two linkages between the most distal three bases on either end of the strand). A NRT2.2 crRNA with the sequence of SEQ ID NO:397 is designed to target the nucleotides shown in bold italic in SEQ ID NO:381 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the NRT2.2 gene is carried out using procedures similar to those described in Examples 13-16.

An increase in expression of NRT2.2 and GLN1.4 (Zm00001d051804) simultaneously is predicted to further increase nitrogen use efficiency. A partial genomic sequence of GLN1.4 is provided as SEQ ID NO:382. A nitrogen responsive element sequence encoded by a polynucleotide (such as a double-stranded DNA, a single-stranded DNA, a single-stranded DNA/RNA hybrid, or a double-stranded DNA/RNA hybrid) donor molecule is inserted upstream of the transcription start site (TSS) of the GLN1.4 coding region at a double-strand break effected between nucleotides at positions 115/116 of SEQ ID NO:382 in order to enhance the expression of GLN1.4. The NRE is provided as a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i. e., the two linkages between the most distal three bases on either end of the strand). A GLN1.4 crRNA with the sequence of SEQ ID NO:398 is designed to target the nucleotide shown in bold italic in SEQ ID NO:382 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the GLN1.4 gene is carried out using procedures similar to those described in Examples 13-16.

An increase in expression of NRT2.2, GLN1.4, and Dof1 (Zm00001d031278) simultaneously is predicted to even further increase nitrogen use efficiency. A partial genomic sequence of Dof1 is provided as SEQ ID NO:383. Constitutive overexpression of Dof1 has been shown to result in increased photosynthesis under low nitrate conditions in rice (DOI: 10.1111/j.1467-7652.2011.00592.x). In this embodiment the expression of Dof1 is modified to be constitutively expressed by inserting a constitutive enhancer sequence. A maize OCS homologue (see Examples 8 and 16) encoded by a chemically modified single-stranded DNA with the sequence of SEQ ID NO:343 (Integrated DNA Technologies, Coralville, Iowa), phosphorylated on the 5' end and containing two phosphorothioate linkages at each terminus (i. e., the two linkages between the most distal three bases on either end of the strand), is designed for insertion upstream of the transcription start site (TSS) of the Dof1 coding region at a double-strand break effected between nucleotides at positions 101/102 of SEQ ID NO:383 in order to enhance the expression of Dof1. A Dof1 crRNA with the sequence of SEQ ID NO:399 is designed to target the nucleotides shown in bold italic in SEQ ID NO:383 (Table 16); crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the maize OCS homologue sequence into the Dof1 gene is carried out using procedures similar to those described in Examples 13-16.

Similar genomic modification is carried out in maize whole plants or in maize plant tissues using procedures as described in Examples 31-34.

Example 19

This example describes the modification of four genes in a maize plant cell to provide increased NUE and to create higher yield through increased kernel number. In this example the proxy assay for increased kernel number is increased expression of the gene Wuschel, which has been shown to be connected to kernel row number (see, e. g., doi:10.1038/ng.3567).

Maize protoplasts are prepared as described in Example 1. Preparation of reagents, gene editing procedures, and detection of gene modifications are carried out using procedures similar to those described in Examples 13-16.

An increase in expression of NRT2.2 (Zm00001d054060) is predicted to increase nitrogen use efficiency. A partial genomic sequence of NRT2.2 is provided as SEQ ID NO:381. A nitrogen responsive element sequence encoded by a polynucleotide (such as a double-stranded DNA, a single-stranded DNA, a single-stranded DNA/RNA hybrid, or a double-stranded DNA/RNA hybrid) is inserted at a double-strand break effected between nucleotides at positions 101/102 of SEQ ID NO:381 in order to enhance the expression of NRT2.2. The nitrogen responsive element (AtNRE, see Examples 9, 13, and 16) is encoded by a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i. e., the two linkages between the most distal three bases on either end of the strand). A NRT2.2 crRNA with the sequence of SEQ ID NO:397 is designed to target the nucleotides shown in bold italic in SEQ ID NO:381 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the NRT2.2 gene is carried out using procedures similar to those described in Examples 13-16.

An increase in expression of NRT2.2 and GLN1.4 (Zm00001d051804) simultaneously is predicted to further increase nitrogen use efficiency. A partial genomic sequence of GLN1.4 is provided as SEQ ID NO:382. A nitrogen responsive element sequence encoded by a polynucleotide (such as a double-stranded DNA, a single-stranded DNA, a single-stranded DNA/RNA hybrid, or a double-stranded DNA/RNA hybrid) donor molecule is inserted at a double-strand break effected between nucleotides at positions 115/116 of SEQ ID NO:382 in order to enhance the expression of GLN1.4. The NRE is provided as a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i. e., the two linkages between the most distal three bases on either end of the strand). A GLN1.4 crRNA with the sequence of SEQ ID NO:398 is designed to target the nucleotide shown in bold italic in SEQ ID NO:382 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the GLN1.4 gene is carried out using procedures similar to those described in Examples 13-16.

An increase in expression of NRT2.2, GLN1.4, and Dof1 (Zm00001d031278) simultaneously is predicted to even further increase nitrogen use efficiency. A partial genomic sequence of Dof1 is provided as SEQ ID NO:383. Constitutive overexpression of Dof1 has been shown to result in increased photosynthesis under low nitrate conditions in rice (see, e. g., DOI: 10.1111/j.1467-7652.2011.00592.x). In this embodiment the expression of Dof1 is modified to be constitutively expressed by inserting a constitutive enhancer sequence. A maize OCS homologue (see Examples 8 and 16) encoded by a chemically modified single-stranded DNA with the sequence of SEQ ID NO:343 (Integrated DNA Technologies, Coralville, Iowa), phosphorylated on the 5' end and containing two phosphorothioate linkages at each terminus (i. e., the two linkages between the most distal three bases on either end of the strand), is designed for insertion at a double-strand break effected between nucleotides at positions 101/102 of SEQ ID NO:383 in order to enhance the expression of Dof1. A Dof1 crRNA with the sequence of SEQ ID NO:399 is designed to target the nucleotides shown in bold italic in SEQ ID NO:383 (Table 16); crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the maize OCS homologue sequence into the Dof1 gene is carried out using procedures similar to those described in Examples 13-16.

An increase in expression of NRT2.2, GLN1.4, and Dof1 and a decrease in expression of FEA3 (Zm00001d040130), a putative Leucine Rich Repeat (LRR) Receptor-like protein, is predicted to provide an increase in the expression of Wuschel and other meristem-promoting genes, resulting in an overall increase in meristem size and ultimately in increased yield (see, e.g., doi:10.1038/ng.3567). A partial genomic sequence of FEA3 including 3' untranslated region (3' UTR) is provided as SEQ ID NO:386. An mRNA destabilizing element oligonucleotide having the sequence TTATTTATTTTATTTATTTTATTTATTTTATTTATT (SEQ ID NO:378) and encoded by a polynucleotide (such as a double-stranded DNA, a single-stranded DNA, a single-stranded DNA/RNA hybrid, or a double-stranded DNA/RNA hybrid) donor molecule is designed for insertion in the 3' UTR of FEA3 at a double-strand break effected between nucleotides at positions 25/26, 143/144, or 263/264 of SEQ ID NO:386 (see Table 16) in order to reduce the expression of FEA3 gene. The nucleotides targeted by each of the three different FEA3 crRNAs are shown in bold italic in SEQ ID NO:386 in Table 16; the crRNA sequences are provided as SEQ ID NOs:402, 403, 404 (see Table 17). All crRNAs and tracrRNA are purchased from Integrated DNA Technologies, Coralville, Iowa. Ribonucleoprotein (RNP) complexes are prepared using guide RNAs (crRNA:tracrRNA) and Cas9 nuclease (Aldevron, Fargo, N. Dak.). Insertion of the mRNA destabilizing element into the 3' untranslated region of the FEA3 gene is carried out using procedures similar to those described in Examples 13-16.

Similar genomic modification is carried out in maize whole plants or in maize plant tissues using procedures as described in Examples 31-34.

Example 20

This example illustrates a method of providing a plant cell having a modified phenotype, the method including introducing double-strand breaks (DSBs) into multiple loci or into multiple genes, and integrating at the DSBs at least three different nucleotide sequences encoded by a polynucleotide (such as a double-stranded DNA, a single-stranded DNA, a single-stranded DNA/RNA hybrid, or a double-stranded DNA/RNA hybrid) donor molecule, and generating loss-of-function alleles by deletion of genome sequences between at least two DSBs. In this non-limiting example, multiple genomic modifications ("multiplexed edits") are effected in a maize cell by using multiple ribonucleoproteins (RNPs), each including a nuclease and a guide RNA (gRNA) and three different nucleotide sequences.

This example describes the modification of six genes in maize protoplast cells to provide increased nitrogen use efficiency, increased kernel number, elevated glyphosate tolerance in the plant cell, and broad spectrum disease resistance.

Maize protoplasts are prepared as described in Example 1. Preparation of reagents, gene editing procedures, and detection of gene modifications are carried out using procedures similar to those described in Examples 13-16.

An increase in expression of NRT2.2 (Zm00001d054060) is predicted to increase nitrogen use efficiency. A partial genomic sequence of NRT2.2 is provided as SEQ ID NO:381. A nitrogen responsive element sequence encoded by a polynucleotide (such as a double-stranded DNA, a single-stranded DNA, a single-stranded DNA/RNA hybrid, or a double-stranded DNA/RNA hybrid) is inserted at a double-strand break effected between nucleotides at positions 101/102 of SEQ ID NO:381 in order to enhance the expression of NRT2.2. The nitrogen responsive element (AtNRE, see Examples 9, 13, and 16) is encoded by a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i.e., the two linkages between the most distal three bases on either end of the strand). A NRT2.2 crRNA with the sequence of SEQ ID NO:397 is designed to target the nucleotides shown in bold italic in SEQ ID NO:381 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the NRT2.2 gene is carried out using procedures similar to those described in Examples 13-16.

An increase in expression of NRT2.2 and GLN1.4 (Zm00001d051804) simultaneously is predicted to further increase nitrogen use efficiency. A partial genomic sequence of GLN1.4 is provided as SEQ ID NO:382. A nitrogen responsive element sequence encoded by a polynucleotide (such as a double-stranded DNA, a single-stranded DNA, a single-stranded DNA/RNA hybrid, or a double-stranded DNA/RNA hybrid) donor molecule is inserted at a double-strand break effected between nucleotides at positions 115/116 of SEQ ID NO:382 in order to enhance the expression of GLN1.4. The NRE is provided as a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i.e., the two linkages between the most distal three bases on either end of the strand). A GLN1.4 crRNA with the sequence of SEQ ID NO:398 is designed to target the nucleotide shown in bold italic in SEQ ID NO:382 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the GLN1.4 gene is carried out using procedures similar to those described in Examples 13-16.

An increase in expression of NRT2.2, GLN1.4, and Dof1 (Zm00001d031278) simultaneously is predicted to even further increase nitrogen use efficiency. A partial genomic sequence of Dof1 is provided as SEQ ID NO:383. Constitutive overexpression of Dof1 has been shown to result in increased photosynthesis under low nitrate conditions in rice (see, e.g., DOI: 10.1111/j.1467-7652.2011.00592.x). In this embodiment the expression of Dof1 is modified to be constitutively expressed by inserting a constitutive enhancer sequence. A maize OCS homologue (see Examples 8 and 16) encoded by a chemically modified single-stranded DNA with the sequence of SEQ ID NO:343 (Integrated DNA Technologies, Coralville, Iowa), phosphorylated on the 5' end and containing two phosphorothioate linkages at each terminus (i.e., the two linkages between the most distal three bases on either end of the strand) is designed for insertion at a double-strand break effected between nucleotides at positions 101/102 of SEQ ID NO:383 in order to enhance the expression of Dof1. A Dof1 crRNA with sequence of SEQ ID NO:399 is designed to target the nucleotides shown in bold italic in SEQ ID NO:383 (Table 16); crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.).

Integration of the maize OCS homologue sequence into the Dof1 gene is carried out using procedures similar to those described in Examples 13-16.

An increase in expression of NRT2.2, GLN1.4, and Dof1 and a loss of function allele of FEA3 (Zm00001d040130), a putative Leucine Rich Repeat (LRR) Receptor-like protein, is expected to provide an increase in the expression of Wuschel and other meristem-promoting genes, resulting in an overall increase in meristem size and ultimately in increased kernel row numbers (see, e. g., doi:10.1038/ng.3567). A partial genomic sequence of FEA3 is provided as SEQ ID NO:387. Two ribonucleoproteins (RNPs), each including a nuclease and a guide RNA (gRNA) are designed to effect double-strand breaks between nucleotides at positions 115/116 and 207/208 of SEQ ID NO:387 (see Table 16), resulting in deletion of genomic sequence of FEA3 gene between the two guide targeting regions and effectively knocking out expression of a functional FEA3 protein. The nucleotides targeted by each of the two FEA3 crRNAs are shown in bold italic in SEQ ID NO:387 in Table 16; the crRNA sequences are provided as SEQ ID NOs:405 and 406 (see Table 17). All crRNAs and tracrRNA are purchased from Integrated DNA Technologies, Coralville, Iowa. Ribonucleoprotein (RNP) complexes are prepared using guide RNAs (crRNA:tracrRNA) and Cas9 nuclease (Aldevron, Fargo, N. Dak.). Functional knock-out by partial sequence deletion of the FEA3 gene is carried out using procedures similar to those described in Examples 13-16.

An increase in the expression of the maize enolpyruvyl-shikimate phosphate synthase 1 (EPSPS, Zm00001d045450) is predicted to be required in order to deliver a plant with commercial-level glyphosate tolerance with no growth or performance drag. A partial genomic sequence of EPSPS is provided as SEQ ID NO:384. In this embodiment, the expression of the endogenous EPSPS is modified to be constitutively expressed by inserting a constitutive enhancer sequence. A maize OCS homologue (see Examples 14 and 23) encoded by a chemically modified single-stranded DNA with the sequence of SEQ ID NO:343 (Integrated DNA Technologies, Coralville, Iowa), phosphorylated on the 5' end and containing two phosphorothioate linkages at each terminus (i. e., the two linkages between the most distal three bases on either end of the strand) is designed for insertion at a double-strand break effected between nucleotides at positions 101/102 of SEQ ID NO:384 in order to provide constitutively increased expression of EPSPS. An EPSPS crRNA with sequence of SEQ ID NO:400 is designed to target the nucleotides shown in bold italic in SEQ ID NO:384 (Table 16); crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the maize OCS homologue sequence into the EPSPS gene is carried out using procedures similar to those described in Examples 13-16.

An increase in the expression of NPR1 (Zm00001d012660) is predicted to increase disease resistance (see, e. g., doi: 10.1094/MPMI-21-9-1215). However, constitutive overexpression results in a significant fitness cost (see, e. g., doi.org/10.1016/j.plantsci.2016.06.005). It is predicted that this undesirable fitness drag will be mitigated by modifying the endogenous NPR1 gene by inserting an upstream ORF (uORF) into the 5'UTR, which will reduce the translation efficiency of the target gene (and hence the fitness drag) in the absence of a pathogen. A partial sequence of NPR1 is provided as SEQ ID NO:385. A uORF sequence encoded by a chemically modified single-stranded DNA with the sequence of SEQ ID NO:379, phosphorylated on the 5' end and containing two phosphorothioate linkages at each terminus (i. e., the two linkages between the most distal three bases on either end of the strand), is designed for insertion at a double-strand break effected between nucleotides at positions 101/102 of SEQ ID NO:385 (see Table 16) in order to modulate the expression of NPR1. The nucleotides targeted by the NPR1 crRNA are shown in bold italic in Table 16. The crRNA sequence is provided as SEQ ID NO:401 (see Table 17). All crRNA and tracrRNA are purchased from Integrated DNA Technologies, Coralville, Iowa. Ribonucleoprotein (RNP) complexes are prepared using guide RNAs (crRNA:tracrRNA) and Cas9 nuclease (Aldevron, Fargo, N. Dak.). Integration of the uORF sequence into the NPR1 gene is carried out using procedures similar to those described in Examples 13-16.

Similar genomic modification is carried out in maize whole plants or in maize plant tissues using procedures as described in Examples 31-34.

TABLE 16

| Name | Sequence | SEQ ID NO | Category |
|---|---|---|---|
| Zm00001d054060 NRT2.2 | TCCATCCTCGCTCTACCTGCCTGCTGCCAGT TTCAACTCTCCAAGGTCAACGCCAGCCCTC GCGCGCTTGGTGTACTCTAGTTTAGTACACC AATCCC*CATGCATTCTTTTTTGTTTG*TTTGTT TGTTTGTTTGTTTTGATTGACAAATATATGC GGCAGAGTTAAGAACGAATCGACTCCGTCG TCTCGGCTAGTCGACC | SEQ ID NO: 381 | DNA; Zea mays |
| Zm00001d051804 GLN1.4 | AGGGGCTTGACGCCTTACCAGTACGCGGTG CTCCCTCTTCTCGCACCTACCGCACGGAGG ATATGACCTAATACAATTAATTTACGCGGA ACTCGAAA*TGTATCCGTATTTATACGTG*TGG AACGTACAAGTATACGTATTTTGTTGGTTTT TTTTTTACTTTTTACCCGGCTGGACGCCAAC CAACTGGTTTCCCGTCCT | SEQ ID NO: 382 | DNA; Zea mays |
| Zm00001d031278 Dof1 | CGGGCCCACGGGAGGTCGCGTCGATTCGCA GCAGCGCGCCGCCCCCCTCCCCACCACCAC GTCAAGCGGCGTGGGCTTCCGCCCCTCCCT GCCCGCCC*CGTGGGCCCCCACTCGCGTC*CT GTAACCGGGATAGCGTGAGCACGTCGCTAT CGTCCGTAACGGCGACCGCGACCATAAGAG AGGAGGCAAAGCCAGCCCCCG | SEQ ID NO: 383 | DNA; Zea mays |

TABLE 16-continued

| Name | Sequence | SEQ ID NO | Category |
|---|---|---|---|
| Zm00001d045450 EPSPS | AGCACGGACGATCCTTTACGTTGTTTTTAAC AAACTTTGTCAGAAAACTAGCATCATTAAC TTCTTAATGACGATTTCACAACAAAAAAG GTAACCT*CGCTACTAACATAACAAAAT*ACTT GTTGCTTATTAATTATATGTTTTTTAATCTTT GATCAGGGGACAACAGTGGTTGATAACCTG TTGAACAGTGAGGATGT | SEQ ID NO: 384 | DNA; Zea mays |
| Zm00001d012660 NPR1 | ATTCCGTTGGACCCCTACCGCTCCTCAGTCA GTCCTCGCCCCTCCCAGCACCGGCCAACAA TCCCTCACGTTATTCCCTGTAGCTACTATGC TGCCCT*CTTGGATCCCTTTTTCACTT*GTCTG AGATTTAGCCACCGCCCGGTAGGAAGAAGA AGGGGAAGCACCATATTTTCTGTTCCTGGC CTGACGCAGCGCCGGTGA | SEQ ID NO: 385 | DNA; Zea mays |
| Zm00001d040130 FEA3 (3'-UTR) | CAAGCA*AGCAGGTTCAGAAGAAGAACA*CGG AGAAACTTGAAGTAATGCTAGGTAGGTTAG CACGAAGTAGTTTCTGCGCGTTCTCTGTGAT CTTTTGGCATTTGTTTTTGGCTGCTGGTGGC TT*ACCATCGTCAGATGGTGACGG*AGGAAGG AGGGAACATGGATCTGGATGGTGTGAGCCA CAGATTACATTACAGTAGTAGAGTAAACTA TGAGAGTTCTTGTGGACTGAAGGTGTGTAG TGG*TGGATAGGGTAGCTTCTCCG*GGGTTCTT TTGTGTG | SEQ ID NO: 386 | DNA; Zea mays |
| Zm00001d040130 FEA3 | GACTTCTGAGCGAGGAGTGGACGAGTGGTG TGCCGTCGTCCGGTTCCCGTTGGTTTGGCGA TGAGGCGCGCTCGCGGTCGCCGCGGGCTGC TGCTTCT*CCTCGGCGTGGCGCTCTCG*GCGGC TGCGCTGCTCCGTGGCTGCGCGGGGCAGCA AGGGGAGGACGGCTCGGACGCCCCTGCGG CGGCGGCGGCGGAGACGGCCCCC*ATGGAG GAGAAGGAGCGC*AGGGCGCTGTACGCCGCC ATCGAGAGCTTCGTCGGCAAGGGGTGGAAC GGCTCCGGGCTCTACCCAGACCCCTGCGGC TGGTCTC | SEQ ID NO: 387 | DNA; Zea mays |

TABLE 17

| Gene | Guide (crRNA) | Orientation (relative to gene sequence) | Cut site | SEQ ID NO | Category |
|---|---|---|---|---|---|
| NRT2.2 ZM00001D054060 | CAAACAAAAAAGAAUGCAUGGU UUUAGAGCUAUGCU | reverse | 101 | SEQ ID NO: 397 | RNA; artificial |
| GLN1.4 ZM00001D051804 | UGUAUCCGUAUUUAUACGUGGU UUUAGAGCUAUGCU | forward | 115 | SEQ ID NO: 398 | RNA; artificial |
| Dof1 ZM00001D031278 | GACGCGAGUGGGGGCCCACGGU UUUAGAGCUAUGCU | reverse | 101 | SEQ ID NO: 399 | RNA; artificial |
| EPSPS ZM00001D045450 | AUUUUGUUAUGUUAGUAGCGG UUUAGAGCUAUGCU | reverse | 101 | SEQ ID NO: 400 | RNA; artificial |
| NPR1 ZM00001D012660 | AAGUGAAAAAGGGAUCCAAGG UUUAGAGCUAUGCU | reverse | 101 | SEQ ID NO: 401 | RNA; artificial |
| FEA3 ZM00001D040130 | GCAGGUUCAGAAGAAGAACAGU UUUAGAGCUAUGCU | forward | 25 | SEQ ID NO: 402 | RNA; artificial |
| FEA3 ZM00001D040130 | CCAUGUCAGAUGGUGACGGGUU UUAGAGCUAUGCU | Forward | 143 | SEQ ID NO: 403 | RNA; artificial |
| FEA3 ZM00001D040130 | UGGAUAGGGUAGCUUCUCCG GUUUAGAGCUAUGCU | forward | 263 | SEQ ID NO: 404 | RNA; artificial |
| FEA3 ZM00001D040130 | GCGCUCCUUCUCCUCCAUGUUU UAGAGCUAUGCU | reverse | 207 | SEQ ID NO: 405 | RNA; artificial |

TABLE 17-continued

| Gene | Guide (crRNA) | Orientation (relative to gene sequence) | Cut site | SEQ ID NO | Category |
|---|---|---|---|---|---|
| FEA3 ZM00001D040130 | CCUCGGCGUGGCGCUCUCGGGU UUUAGAGCUAUGCU | forward | 115 | SEQ ID NO: 406 | RNA; artificial |

Example 21

This example illustrates culture conditions effective in improving viability of plant cells or plant protoplasts. More specifically, this non-limiting example describes media and culture conditions for improving viability of isolated plant protoplasts.

Table 18 provides the compositions of different liquid basal media suitable for culturing plant cells or plant protoplasts; final pH of all media was adjusted to 5.8 if necessary.

TABLE 18

| | Concentration (mg/L unless otherwise noted) | | | | |
|---|---|---|---|---|---|
| Component | SH | 8p | PIM | P2 | YPIM B- |
| Casamino acids | | 250 | | | |
| Coconut water | | 20000 | | | |
| Ascorbic acid | | 2 | | | |
| biotin | | 0.01 | 0.01 | | |
| Cholicalciferol (Vitamin D-3) | | 0.01 | | | |
| choline chloride | | 1 | | | |
| Citric acid | | 40 | | | |
| Cyanocobalamin (Vitamin B-12) | | 0.02 | | | |
| D-calcium pantothenate | | 1 | 1 | | |
| D-Cellobiose | | 250 | | | |
| D-Fructose | | 250 | | | |
| D-Mannose | | 250 | | | |
| D-Ribose | | 250 | | | |
| D-Sorbitol | | 250 | | | |
| D-Xylose | | 250 | | | |
| folic acid | | 0.4 | 0.2 | | |
| Fumaric acid | | 40 | | | |
| L-Malic acid | | 40 | | | |
| L-Rhamnose | | 250 | | | |
| p-Aminobenzoic acid | | 0.02 | | | |
| Retinol (Vitamin A) | | 0.01 | | | |
| Riboflavin | | 0.2 | | | |
| Sodium pyruvate | | 20 | | | |
| 2,4-D | 0.5 | 0.2 | 1 | 5 | 1 |
| 6-benzylaminopurine (BAP) | | | | | 1 |
| Indole-3-butyric acid (IBA) | | | | 2.5 | |
| Kinetin | 0.1 | | | | |
| Naphthaleneacetic acid (NAA) | | 1 | | | |
| parachlorophenoxyacetate (pCPA) | 2 | | | | |
| Thidiazuron | | | 0.022 | | |
| Zeatin | | 0.5 | | | |
| AlCl3 | | | 0.03 | | |
| Bromocresol purple | | 8 | | | |
| CaCl$_2$•2H$_2$0 | 200 | 600 | 440 | 200 | 440 |
| CoCl$_2$•6H$_2$O | 0.1 | 0.025 | | 0.1 | |
| CuSO$_4$•5H$_2$O | 0.2 | 0.025 | 0.03 | 0.2 | 0.03 |
| D-Glucose | | 68400 | 40000 | | 40000 |
| D-Mannitol | 52000 | 250 | 60000 | 52000 | 60000 |
| FeSO$_4$•7H$_2$O | 15 | 27.8 | 15 | 15 | 15 |
| H$_3$BO$_3$ | 5 | 3 | 1 | 5 | 1 |
| KCl | | 300 | | | |
| KH$_2$PO$_4$ | | 170 | 170 | | 170 |
| KI | 1 | 0.75 | 0.01 | 1 | 0.01 |
| KNO$_3$ | 2500 | 1900 | 505 | 2500 | 505 |
| MES pH 5.8 (mM) | | | 3.586 | 25 | 25 |
| MgSO$_4$•7H$_2$O | 400 | 300 | 370 | 400 | 370 |
| MnSO$_4$•H$_2$O | 10 | io | 0.1 | 10 | 0.1 |
| Na$_2$EDTA | 20 | 37.3 | 20 | 20 | 20 |
| Na2MoO$_4$•2H$_2$O | 0.1 | 0.25 | | 0.1 | |
| NH$_4$H$_2$PO$_4$ | 300 | | | 300 | |
| NH$_4$NO$_3$ | | 600 | 160 | | 160 |
| NiCl$_2$•6H$_2$O | | | 0.03 | | |
| Sucrose | 30000 | 2500 | | 30000 | |

TABLE 18-continued

| Component | Concentration (mg/L unless otherwise noted) | | | | |
|---|---|---|---|---|---|
| | SH | 8p | PIM | P2 | YPIM B- |
| ZnSO$_4$•7H$_2$O | 1 | 2 | 1 | 1 | 1 |
| TWEEN ® 80 (microliter/L) | | | 10 | | 10 |
| Inositol | 1000 | 100 | 100 | 1000 | 100 |
| Nicotinamide | | 1 | | | |
| Nicotinic acid | 5 | | 1 | 5 | 1 |
| Pyridoxinc•HCl | 0.5 | 1 | 1 | 0.5 | 1 |
| Thiaminc•HCl | 5 | 1 | 1 | 5 | 1 |

\* Sources for basal media:
SH - Schenk and Hildebrandt, Can. J. Bot. 50: 199 (1971).
8p - Kao and Michayluk, Planta 126: 105 (1975).
P2 - SH but with hormones from Potrykus et al., Mol. Gen. Genet. 156: 347 (1977).
PIM - Chupeau et al., The Plant Cell 25: 2444 (2013).

Example 22

This example illustrates culture conditions effective in improving viability of plant cells or plant protoplasts. More specifically, this non-limiting example describes methods for encapsulating isolated plant protoplasts.

When protoplasts are encapsulated in alginate or pectin, they remain intact far longer than they would in an equivalent liquid medium. In order to encapsulate protoplasts, a liquid medium ("calcium base") is prepared that is in all other respects identical to the final desired recipe with the exception that the calcium (usually CaCl2.2H2O) is increased to 80 millimolar. A second medium ("encapsulation base") is prepared that has no added calcium but contains 10 g/L of the encapsulation agent, e. g., by making a 20 g/L solution of the encapsulation agent and adjusting its pH with KOH or NaOH until it is about 5.8, making a 2× solution of the final medium (with no calcium), then combining these two solutions in a 1:1 ratio. Encapsulation agents include alginate (e. g., alginic acid from brown algae, catalogue number A0682, Sigma-Aldrich, St. Louis, Mo.) and pectin (e. g., pectin from citrus peel, catalogue number P9136, Sigma-Aldrich, St. Louis, Mo.; various pectins including non-amidated low-methoxyl pectin, catalogue number 1120-50 from Modernist Pantry, Portsmouth, N.H.). The solutions, including the encapsulation base solution, is filter-sterilized through a series of filters, with the final filter being a 0.2-micrometer filter. Protoplasts are pelleted by gentle centrifugation and resuspended in the encapsulation base; the resulting suspension is added dropwise to the calcium base, upon which the protoplasts are immediately encapsulated in solid beads.

Example 23

This example illustrates culture conditions effective in improving viability of plant cells or plant protoplasts. More specifically, this non-limiting example describes observations of effects on protoplast viability obtained by adding non-conventionally high levels of divalent cations to culture media.

Typical plant cell or plant protoplast media contain between about 2 to about 4 millimolar calcium cations and between about 1-1.5 millimolar magnesium cations. In the course of experiments varying and adding components to media, it was discovered that the addition of non-conventionally high levels of divalent cations had a surprisingly beneficial effect on plant cell or plant protoplast viability. Beneficial effects on plant protoplast viability begin to be seen when the culture medium contains about 30 millimolar calcium cations (e. g., as calcium chloride) or about 30 millimolar magnesium cations (e. g., as magnesium chloride). Even higher levels of plant protoplast viability were observed with increasing concentrations of calcium or magnesium cations, i. e., at about 40 millimolar or about 50 millimolar calcium or magnesium cations. The result of several titration experiments indicated that greatest improvement in protoplast viability was seen using media containing between about 50 to about 100 millimolar calcium cations or 50 to about 100 millimolar magnesium cations; no negative effects on protoplast viability or physical appearance was observed at these high cation levels. This was observed in multiple experiments using protoplasts obtained from several plant species including maize (multiple germplasms, e. g., B73, A188, B104, HiIIA, HiIIB, BMS), rice, wheat, soy, kale, and strawberry; improved protoplast viability was observed in both encapsulated protoplasts and non-encapsulated protoplasts. Addition of potassium chloride at the same levels had no effect on protoplast viability. It is possible that inclusion of slightly lower (but still non-conventionally high) levels of divalent cations (e. g., about 10 millimolar, about 15 millimolar, about 20 millimolar, or about 25 millimolar calcium cations or magnesium cations) in media is beneficial for plant cells or plant protoplasts of additional plant species.

Example 24

This example illustrates culture conditions effective in improving viability of plant cells or plant protoplasts. More specifically, this non-limiting example describes observations of effects on maize protoplast viability obtained by adding non-conventionally high levels of divalent cations to culture media.

Separate suspensions of maize B73 and A188 protoplasts (2×10^5 cells per milliliter) were prepared in YPIM B-liquid medium containing various combinations of the added salts calcium chloride, potassium ascorbate, and magnesium chloride or magnesium sulfate. One-half milliliter aliquots of the suspensions were dispensed into a 24-well microtiter plate in the arrangement shown in Table 19, which lists the concentrations of calcium chloride ("Ca"), potassium ascorbate ("A"), and magnesium chloride ("MgCl2") or magnesium sulfate ("MgSO4") in millimolar values.

TABLE 19

| YPIM B- | Ca = 0, A = 0.1 | Ca = 0, A = 0.2 | Ca = 0, A = 0.5 | Ca = 0, A = 1 | YPIM B- |
|---|---|---|---|---|---|
| Ca = 50, A = 0 | Ca = 50, A = 0.1 | Ca = 50, A = 0.2 | Ca = 50, A = 0.5 | Ca = 50, A = 1 | YPIM B- |
| Ca = 100, A = 0 | Ca = 100, A = 0.1 | Ca = 100, A = 0.2 | Ca = 100, A = 0.5 | Ca = 100, A = 1 | YPIM B- |
| YPIM B- | $MgCl_2$ = 50 | $MgCl_2$ = 100 | $MgSO_4$ = 50 | $MgSO_4$ = 100 | YPIM B- |

Viability was judged by Evans blue staining and visualization under a light microscope. After 96 hours, both maize species were still highly viable in all wells. After 288 hours, there were clear differences at various calcium and magnesium concentrations, but only slight effects at various ascorbate concentrations.

The observations at 288 hours were recorded as follows: Maize B73: protoplasts in all Ca=0 wells appeared small and dead; protoplasts in Ca=50 wells appeared larger but were now also almost all dead; protoplasts in Ca=100 wells still appeared larger and had a viability of between 10-20%. Protoplasts in MgCl2=50 wells were similar to those in Ca=100 wells, and protoplasts in MgCl2=100 wells had much higher viability than any well. Wells with MgSO4=50 or 100 showed only a modest improvement in protoplast viability. Maize A188: protoplasts in all Ca=0 wells appeared small and dead; protoplasts in Ca=50 wells appeared and had about 20% viability; protoplasts in Ca=100 wells had about 70% viability and were visibly healthier. Addition of ascorbate at 0.2 millimolar and above to the wells with added calcium appeared to slightly decrease viability. Wells with MgSO4=50 had about 30-40% viability, and wells with MgCl2=100 had about 70% viability. Wells with MgSO4=50 or 100 showed only a modest improvement in protoplast viability. These results demonstrate that calcium chloride or magnesium chloride added at non-conventionally high levels improved maize protoplast viability over a culture time of ~12 days.

Example 25

This example illustrates culture conditions effective in improving viability of plant cells or plant protoplasts. More specifically, this non-limiting example describes observations of effects on maize, soybean, and strawberry protoplast viability obtained by adding non-conventionally high levels of divalent cations to culture media.

Separate suspensions of maize B73, winter wheat, soy, and strawberry protoplasts (2×10^5 cells per milliliter) were prepared in YPIM B-liquid medium containing calcium chloride at 0, 50, or 100 millimolar. One-half milliliter aliquots of the suspensions were dispensed into a 24-well microtiter plate.

Viability at day 8 of culture was judged by visualization under a light microscope. At this point, the viability of the maize protoplasts in the 0, 50, and 100 millimolar calcium conditions was 10%, 30%, and 80%, respectively. There were no large differences observed at this time point for protoplasts of the other species.

Viability at day 13 was judged by Evans blue staining and visualization under a light microscope. At this point, the viability of the maize protoplasts in the 0, 50, and 100 millimolar calcium conditions was 0%, 0%, and 10%, respectively; viability of the soybean protoplasts in the 0, 50, and 100 millimolar calcium conditions was 0%, 50%, and 50%, respectively; and viability of the maize protoplasts in the 0 and 50 millimolar calcium conditions was 0% and 50%, respectively (viability was not measured for the 100 millimolar condition). These results demonstrate that culture conditions including calcium cations at 50 or 100 millimolar improved viability of both monocot and dicot protoplasts over a culture time of ~13 days.

Example 26

This example illustrates culture conditions effective in improving viability of plant cells or plant protoplasts. More specifically, this non-limiting example describes observations of effects on maize protoplast viability obtained by adding non-conventionally high levels of divalent cations to culture media.

Separate suspensions of maize A188 protoplasts (2×10^5 cells per milliliter) were prepared in YPIM B-liquid medium containing calcium chloride at 0 or 50 millimolar. One-half milliliter aliquots of the suspensions were dispensed into a 24-well microtiter plate.

Viability was judged by visualization under a light microscope. At 96 hours, protoplasts grown with 50 millimolar calcium cations appeared healthier than those grown with no added calcium. At 168 hours (7 days), wells with 50 millimolar calcium cations still contained very many large, healthy-looking protoplasts, whereas protoplasts in the wells with no added calcium were nearly all dead. This experiment was carried on to day 20, at which point the protoplasts in the wells with 50 millimolar calcium had generated cell walls and undergone at least some cell division. These results demonstrate that culture conditions including calcium cations at 50 millimolar improved viability, cell wall regeneration, and cell division of maize protoplasts over a culture time of at least 7 to 20 days.

Example 27

This example illustrates culture conditions effective in improving viability of plant cells or plant protoplasts. More specifically, this non-limiting example describes observations of effects on maize protoplast viability obtained by adding non-conventionally high levels of divalent cations to culture media.

Separate suspensions of maize B73 protoplasts (2×10^5 cells per milliliter) were prepared in PIM B-liquid medium (identical to YPIM B-medium except with the 6-benzylaminopurine substituted with 0.022 milligrams/L thidiazuron) containing calcium chloride added at 0, 5, 20, 40, 70, or 100 millimolar. One-half milliliter aliquots of the suspensions were dispensed into a 24-well microtiter plate.

Viability was judged by visualization under a light microscope at day 7 and at day 14 of culture. In this experiment, by day 7 the maize protoplasts were dead in the wells containing less than 40 millimolar calcium; the maize protoplasts in the wells containing 40, 70, or 100 millimolar calcium formed clusters of viable, healthy cells with cell division occurring, with the strongest enhanced viability and cell division observed at 100 millimolar calcium. These results demonstrate that culture conditions including calcium cations at 40, 70, or 100 improved viability, cell wall regeneration, and cell division of maize protoplasts over a culture time of at least 7 to 14 days.

Example 28

This example illustrates culture conditions effective in improving viability of plant cells or plant protoplasts. More specifically, this non-limiting example describes observations of effects on maize protoplast viability obtained by adding non-conventionally high levels of divalent cations to culture media.

Separate suspensions of maize B73 and A188 protoplasts ($2 \times 10^5$ cells per milliliter) were prepared in PIM B-liquid medium (identical to YPIM B-medium except with the 6-benzylaminopurine substituted with 0.022 milligrams/L thidiazuron) containing calcium chloride added at 0 or 50 millimolar. One-half milliliter aliquots of the suspensions were dispensed into a 24-well microtiter plate.

Viability was judged by visualization under a light microscope. In this experiment, by day 6 the maize A188 protoplasts were about 40% viable in the wells containing no added calcium but showed much higher viability in the wells containing 50 millimolar calcium, where several wells showed 100% viability. The maize B73 protoplasts in the wells containing no added calcium had all died, but wells containing 50 millimolar calcium still contained viable cells.

Example 29

This example illustrates culture conditions effective in improving viability of plant cells or plant protoplasts. More specifically, this non-limiting example describes observations of effects on maize protoplast viability obtained by adding non-conventionally high levels of divalent cations or a low-molecular-weight antioxidant to culture media.

Separate suspensions of maize B73 and A188 protoplasts ($2 \times 10^5$ cells per milliliter) were prepared in YPIM B-liquid medium containing (a) calcium chloride added at 100 millimolar, or (b) 1 millimolar glutathione, or (c) no added calcium or glutathione. One-milliliter aliquots of the suspensions were dispensed into a 24-well microtiter plate. At 16, 40, 64, and 136 hours of culture, 50-microliter samples were taken for hemocytometer analysis from each well; for the plates containing maize A188 protoplasts, parallel 50-microliter samples were taken from a replicate well at 16, 40, and 64 hours of culture for quantification using a Cellometer cell counter (Nexcelom Bioscience LLC, Lawrence, Mass.).

Viability was determined by Evans blue staining and quantification using a hemocytometer. Under conditions with high concentrations of calcium, Evans blue can create precipitates that interfere with cell counting; to prevent this, 5 microliters of an EDTA solution was added to the samples from the wells containing 100 millimolar calcium chloride immediately prior to staining. Results from the hemocytometer analysis are provided in Table 20 (results from the Cellometer analysis were very similar); "Control"=YPIM B-medium with no added calcium or glutathione. These results demonstrate that inclusion in the medium of either non-conventionally high (100 millimolar) calcium cations or the low-molecular-weight thiol antioxidant glutathione resulted in increasing protoplast viability of both maize lines by (a) at least 10% higher after 30 hours (in this example, about 10-34% higher at 40 hours) culture; (b) at least 10% higher after 48 hours' culture hours (in this example, between 17-53% higher at 64 hours); or (c) at least 10% higher after 72 hours' culture hours or at least 10% higher after 96 hours' culture hours (in this example, about 12—at least 46% higher at 138 hours).

TABLE 20

| Cell Type | Hours | Viability (%) | | |
| --- | --- | --- | --- | --- |
| | | Control | 100 mM Ca | 1 mM GSH |
| B73 | 0 | 90 | 90 | 90 |
| | 16 | 65 | 65 | 77 |
| | 40 | 38 | 57 | 72 |
| | 64 | 31 | 58 | 48 |
| | 136 | 12 | 30 | 24 |
| A188 | 0 | 90 | 90 | 90 |
| | 16 | 60 | 67 | 69 |
| | 40 | 40 | 57 | 50 |
| | 64 | 6 | 59 | 50 |
| | 136 | 0 | 46 | 42 |

Example 30

This example illustrates culture conditions effective in improving viability of plant cells or plant protoplasts. More specifically, this non-limiting example describes observations of effects on maize protoplast viability obtained by adding non-conventionally high levels of divalent cations to culture media.

Separate suspensions of maize protoplasts from five different germplasm lines (A188, B73, B104, HiIIA, HiIIB) ($2 \times 10^5$ cells per milliliter) were prepared in YPIM B-liquid medium containing calcium chloride added at 0, 50, or 100 millimolar. One-half milliliter aliquots of the suspensions were dispensed into a 24-well microtiter plate.

Viability was judged by visualization under a light microscope. At 19 hours, protoplasts of all five maize lines grown under the different conditions appeared healthy, with large proportions of round, green cells; slightly more debris was observed in the 0 calcium conditions. At 34 hours, protoplasts of all five maize lines showed a response to the increased calcium conditions similar to what had been previously observed; across the five maize lines, viability of protoplasts grown without added calcium was about 40%, while those grown with 50 millimolar calcium was about 55%, and those grown with 100 millimolar calcium was about 70%. These results demonstrate that culture conditions including calcium cations at 50 or 100 millimolar improved viability of protoplasts from various maize germplasm over a culture time of 34 hours.

Example 31

This example illustrates genome editing in plants and further illustrates a method of delivering gene-editing effector molecules into a plant cell. This example describes introducing at least one double-strand break (DSB) in a genome in a plant cell or plant protoplast, by delivering at least one effector molecules to the plant cell or plant protoplast using at least one physical agent, such as a particulate, microparticulate, or nanoparticulate. More specifically, this non-limiting example illustrates introducing at least one double-strand break (DSB) in a genome in a plant cell or plant protoplast by contacting the plant cell or plant protoplast with a composition including at least one sequence-specific nuclease and at least one physical agent, such as at least one nanocarrier. Embodiments include those wherein the nanocarrier comprises metals (e. g., gold, silver, tungsten, iron, cerium), ceramics (e. g., aluminum oxide, silicon carbide, silicon nitride, tungsten carbide), polymers (e. g., polystyrene, polydiacetylene, and poly(3,4-ethylenedioxythiophene) hydrate), semiconductors (e. g., quantum dots), silicon (e. g., silicon carbide), carbon (e. g., graphite, graphene, graphene oxide, or carbon nanosheets, nanocomplexes, or nanotubes), composites (e. g., polyvinylcarbazole/graphene, polystyrene/graphene, platinum/graphene, palladium/graphene nanocomposites), a polynucleotide, a poly (AT), a polysaccharide (e. g., dextran, chitosan, pectin, hyaluronic acid, and hydroxyethylcellulose), a polypeptide, or a combination of these. In embodiments, such particulates and nanoparticulates are further covalently or non-covalently functionalized, or further include modifiers or cross-linked materials such as polymers (e. g., linear or branched polyethylenimine, poly-lysine), polynucleotides (e. g., DNA or RNA), polysaccharides, lipids, polyglycols (e. g., polyethylene glycol, thiolated polyethylene glycol), polypeptides or proteins, and detectable labels (e. g., a fluorophore, an antigen, an antibody, or a quantum dot). Embodiments include those wherein the nanocarrier is a nanotube, a carbon nanotube, a multi-walled carbon nanotube, or a single-walled carbon nanotube. Specific nanocarrier embodiments contemplated herein include the single-walled carbon nanotubes, cerium oxide nanoparticles ("nanoceria"), and modifications thereof (e. g., with cationic, anionic, or lipid coatings) described in Giraldo et al. (2014) *Nature Materials,* 13:400-409; the single-walled carbon nanotubes and heteropolymer complexes thereof described in Zhang et al. (2013) *Nature Nanotechnol.,* 8:959-968 (doi:10.1038/NNANO.2013.236); the single-walled carbon nanotubes and heteropolymer complexes thereof described in Wong et al. (2016) *Nano Lett.,* 16:1161-1172; and the various carbon nanotube preparations described in US Patent Application Publication US 2015/0047074 and International Patent Application PCT/US2015/050885 (published as WO 2016/044698 and claiming priority to U.S. Provisional Patent Application 62/052,767), all of which patent applications are incorporated in their entirety by reference herein. See also, for example, the various types of particles and nanoparticles, their preparation, and methods for their use, e. g., in delivering polynucleotides and polypeptides to cells, disclosed in US Patent Application Publications 2010/0311168, 2012/0023619, 2012/0244569, 2013/0145488, 2013/0185823, 2014/0096284, 2015/0040268, 2015/0047074, and 2015/0208663, all of which are incorporated herein by reference in their entirety.

In these examples, single-walled carbon nanotubes (SWCNT) and modifications thereof are prepared as described in Giraldo et al. (2014) *Nature Materials,* 13:400-409; Zhang et al. (2013) *Nature Nanotechnol.,* 8:959-968; Wong et al. (2016) *Nano Lett.,* 16:1161-1172; US Patent Application Publication US 2015/0047074; and International Patent Application PCT/US2015/050885 (published as WO 2016/044698). In an initial experiment, a DNA plasmid encoding green fluorescent protein (GFP) as a reporter is non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. Efficiency of the SWCNT delivery of GFP across the plant cell wall and the cellular localization of the GFP signal is evaluated by microscopy.

In another experiment, plasmids encoding Cas9 and at least one guide RNA (gRNA), are non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. The gRNA is designed to target the endogenous plant gene phytoene desaturase (PDS) for silencing, where PDS silencing produces a visible phenotype (bleaching, or low/no chlorophyll).

In another experiment, RNA encoding Cas9 and at least one guide RNA (gRNA), are non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. The gRNA is designed to target the endogenous plant gene phytoene desaturase (PDS) for silencing, where PDS silencing produces a visible phenotype (bleaching, or low/no chlorophyll).

In another experiment, a ribonucleoprotein (RNP), prepared by complexation of Cas9 nuclease and at least one guide RNA (gRNA), is non-covalently complexed with a SWCNT preparation and tested on various plant cell preparations including plant cells in suspension culture, plant callus, plant embryos, intact or half seeds, and shoot apical meristem. Delivery to the plant callus, embryos, seeds, and meristem is by treatment with pressure, centrifugation, bombardment, microinjection, infiltration (e. g., with a syringe), or by direct application to the surface of the plant tissue. The gRNA is designed to target the endogenous plant gene phytoene desaturase (PDS) for silencing, where PDS silencing produces a visible phenotype (bleaching, or low/no chlorophyll).

One of skill in the art would recognize that the above general compositions and procedures can be modified or combined with other reagents and treatments, such as those described in detail in the paragraphs following the heading "Delivery Methods and Delivery Agents". In addition, the single-walled carbon nanotubes (SWCNT) and modifications thereof prepared as described in Giraldo et al. (2014) *Nature Materials,* 13:400-409; Zhang et al. (2013) *Nature Nanotechnol.,* 8:959-968; Wong et al. (2016) *Nano Lett.,* 16:1161-1172; US Patent Application Publication US 2015/0047074; and International Patent Application PCT/US2015/050885 (published as WO 2016/044698) can be used to prepare complexes with other polypeptides or polynucleotides or a combination of polypeptides and polynucleotides (e. g., with one or more polypeptides or ribonucleoproteins including at least one functional domain selected from the group consisting of: transposase domains, integrase domains, recombinase domains, resolvase domains, invertase domains, protease domains, DNA methyltransferase domains, DNA hydroxylmethylase domains, DNA demethylase domains, histone acetylase domains, histone deacetylase domains, nuclease domains, repressor domains, activator domains, nuclear-localization signal domains, transcription-regulatory protein (or transcription complex recruiting) domains, cellular uptake activity associated domains, nucleic acid binding domains, antibody presentation domains, histone modifying enzymes, recruiter of histone modifying enzymes, inhibitor of histone modifying enzymes, histone methyltransferases, histone demethylases, histone kinases, histone phosphatases, histone ribosylases, histone deribosylases, histone ubiquitinases, histone deubiquitinases, histone biotinases, and histone tail proteases).

Example 32

This example illustrates genome editing in plants and further illustrates a method of delivering gene-editing effector molecules into a plant cell. More specifically, this non-limiting example describes introducing at least one double-strand break (DSB) in a genome in a plant cell or plant protoplast, by contacting the plant cell or plant protoplast with a composition including a sequence-specific nuclease complexed with a gold nanoparticle.

In embodiments, at least one double-strand break (DSB) is introduced in a genome in a plant cell or plant protoplast, by contacting the plant cell or plant protoplast with a composition that includes a charge-modified sequence-specific nuclease complexed to a charge-modified gold nanoparticle, wherein the complexation is non-covalent, e. g., through ionic or electrostatic interactions. In an embodiment, a sequence-specific nuclease having at least one region bearing a positive charge forms a complex with a negatively-charged gold particle; in another embodiment, a sequence-specific nuclease having at least one region bearing a negative charge forms a complex with a positively-charged gold particle. Any suitable method can be used for modifying the charge of the nuclease or the nanoparticle, for instance, through covalent modification to add functional groups, or non-covalent modification (e. g., by coating a nanoparticle with a cationic, anionic, or lipid coating). In embodiments, the sequence-specific nuclease is a type II Cas nuclease having at least one modification selected from the group consisting of: (a) modification at the N-terminus with at least one negatively charged moiety; (b) modification at the N-terminus with at least one moiety carrying a carboxylate functional group; (c) modification at the N-terminus with at least one glutamate residue, at least one aspartate residue, or a combination of glutamate and aspartate residues; (d) modification at the C-terminus with a localization signal, transit, or targeting peptide; (e) modification at the C-terminus with a nuclear localization signal (NLS), a chloroplast transit peptide (CTP), or a mitochondrial targeting peptide (MTP). In embodiments, the type II Cas nuclease is a Cas9 from *Streptococcus pyogenes* wherein the Cas9 is modified at the N-terminus with at least one negatively charged moiety and modified at the C-terminus with a nuclear localization signal (NLS), a chloroplast transit peptide (CTP), or a mitochondrial targeting peptide (MTP). In embodiments, the type II Cas nuclease is a Cas9 from *Streptococcus pyogenes* wherein the Cas9 is modified at the N-terminus with a polyglutamate peptide and modified at the C-terminus with a nuclear localization signal (NLS). In embodiments, the gold nanoparticle has at least one modification selected from the group consisting of: (a) modification with positively charged moieties; (b) modification with at least one moiety carrying a positively charged amine; (c) modification with at least one polyamine; (d) modification with at least one lysine residue, at least one histidine residue, at least one arginine residue, at least one guanidine, or a combination thereof. Specific embodiments include those wherein: (a) the sequence-specific nuclease is a type II Cas nuclease modified at the N-terminus with at least one negatively charged moiety and modified at the C-terminus with a nuclear localization signal (NLS), a chloroplast transit peptide (CTP), or a mitochondrial targeting peptide (MTP); and the gold nanoparticle is modified with at least one positively charged moiety; (b) the type II Cas nuclease is a Cas9 from *Streptococcus pyogenes* modified at the N-terminus with a polyglutamate peptide and modified at the C-terminus with a nuclear localization signal (NLS); and the gold nanoparticle is modified with at least one at least one lysine residue, at least one histidine residue, at least one arginine residue, at least one guanidine, or a combination thereof; (c) the type II Cas nuclease is a Cas9 from *Streptococcus pyogenes* modified at the N-terminus with a polyglutamate peptide that includes at least 15 glutamate residues and modified at the C-terminus with a nuclear localization signal (NLS); and wherein the gold nanoparticle is modified with at least one at least one lysine residue, at least one histidine residue, at least one arginine residue, at least one guanidine, or a combination thereof. In a specific embodiment, at least one double-strand break (DSB) is introduced in a genome in a plant cell or plant protoplast, by contacting the plant cell or plant protoplast with a composition including a sequence-specific nuclease complexed with a gold nanoparticle, wherein the sequence-specific nuclease is a Cas9 from *Streptococcus pyogenes* modified at the N-terminus with a polyglutamate peptide that includes at least 15 glutamate residues and modified at the C-terminus with a nuclear localization signal (NLS); and wherein the gold nanoparticle is in the form of cationic arginine gold nanoparticles (ArgNPs), and wherein when the modified Cas9 and the ArgNPs are mixed, self-assembled nanoassemblies are formed as described in Mout et al. (2017) ACS Nano, doi:10.1021/acsnano.6b07600. Other embodiments contemplated herein include the various nanoparticle-protein complexes (e. g., amine-bearing nanoparticles complexed with carboxylate-bearing proteins) described in International Patent Application PCT/US2016/015711, published as International Patent Application Publication WO2016/123514, which claims priority to U.S. Provisional Patent Applications 62/109,389, 62/132,798, and 62/169,805, all of which patent applications are incorporated in their entirety by reference herein.

In embodiments, the sequence-specific nuclease is an RNA-guided DNA endonuclease, such as a type II Cas nuclease, and the composition further includes at least one guide RNA (gRNA) for an RNA-guided nuclease, or a DNA encoding a gRNA for an RNA-guided nuclease. The method effects the introduction of at least one double-strand break (DSB) in a genome in a plant cell or plant protoplast; in embodiments, the genome is that of the plant cell or plant protoplast; in embodiments, the genome is that of a nucleus, mitochondrion, plastid, or endobiont in the plant cell or plant protoplast. In embodiments, the at least one double-strand break (DSB) is introduced into coding sequence, non-coding sequence, or a combination of coding and non-coding sequence. In embodiments, the plant cell or plant protoplast is a plant cell in an intact plant or seedling or plantlet, a plant tissue, seed, embryo, meristem, germline cells, callus, or a suspension of plant cells or plant protoplasts.

In embodiments, at least one dsDNA molecule is also provided to the plant cell or plant protoplast, and is integrated at the site of at least one DSB or at the location where genomic sequence is deleted between two DSBs. Embodiments include those wherein: (a) the at least one DSB is two blunt-ended DSBs, resulting in deletion of genomic sequence between the two blunt-ended DSBs, and wherein the dsDNA molecule is blunt-ended and is integrated into the genome between the two blunt-ended DSBs; (b) the at least one DSB is two DSBs, wherein the first DSB is blunt-ended and the second DSB has an overhang, resulting in deletion of genomic sequence between the two DSBs, and wherein the dsDNA molecule is blunt-ended at one terminus and has an overhang on the other terminus, and is integrated into the genome between the two DSBs; (c) the at least one DSB is two DSBs, each having an overhang, resulting in deletion of genomic sequence between the two DSBs, and wherein the dsDNA molecule has an overhang at each terminus and is integrated into the genome between the two DSBs.

In a non-limiting example, self-assembled green fluorescent protein (GFP)/cationic arginine gold nanoparticles (ArgNPs), nanoassemblies are prepared as described in International Patent Application Publication WO2016/123514. The GFP/ArgNP nanoassemblies are delivered to maize protoplasts and to kale protoplasts prepared as described in Example 1, and to protoplasts prepared from the Black Mexican Sweet (BMS) maize cell line. Efficiency of transfection or delivery is assessed by fluorescence microscopy at time points after transfection (30 minutes, 1 hour, 3 hours, 6 hours, and overnight).

In a non-limiting example, self-assembled GFP/cationic arginine gold nanoparticles (ArgNPs), nanoassemblies are prepared as described in International Patent Application Publication WO2016/123514. The GFP/ArgNP nanoassemblies are co-incubated with plant cells in suspension culture. Efficiency of transfection or delivery across the plant cell wall is assessed by fluorescence microscopy at time points after transfection (30 minutes, 1 hour, 3 hours, 6 hours, and overnight).

In a non-limiting example, self-assembled GFP/cationic arginine gold nanoparticles (ArgNPs), nanoassemblies are prepared as described in International Patent Application Publication WO2016/123514. The GFP/ArgNP nanoassemblies are further prepared for Biolistics or particle bombardment and thus delivered to plant cells from suspension cultures transferred to semi-solid or solid media, as well as to rice embryogenic callus. Efficiency of transfection or delivery across the plant cell wall is assessed by fluorescence microscopy at time points after transfection (30 minutes, 1 hour, 3 hours, 6 hours, and overnight).

In a non-limiting example, self-assembled GFP/cationic arginine gold nanoparticles (ArgNPs), nanoassemblies are prepared as described in International Patent Application Publication WO2016/123514. The GFP/ArgNP nanoassemblies are delivered by infiltration (e. g., using mild positive pressure or negative pressure) into leaves of *Arabidopsis thaliana* plants. Efficiency of transfection or delivery across the plant cell wall is assessed by fluorescence microscopy at time points after transfection (30 minutes, 1 hour, 3 hours, 6 hours, and overnight).

In a non-limiting example, self-assembled Cas9/ArgNP nanoassemblies are prepared as described in Mout et al. (2017) ACS Nano, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are delivered to maize protoplasts prepared as described in Example 1, and to protoplasts prepared from the Black Mexican Sweet (BMS) maize cell line. In one variation of the procedure, the Cas9/ArgNP nanoassemblies are co-delivered with at least one guide RNA (such as those described in Examples 3-7) to the protoplasts. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the protoplasts. Efficiency of editing is assessed by any suitable method such as a heteroduplex cleavage assay or by sequencing, as described elsewhere in this disclosure.

In a non-limiting example, self-assembled Cas9/ArgNP nanoassemblies are prepared as described in Mout et al. (2017) ACS Nano, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are co-incubated with plant cells in suspension culture. In one variation of the procedure, the Cas9/ArgNP nanoassemblies are co-delivered with at least one guide RNA (such as those described in Examples 3-7) to the plant cells in suspension culture. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the plant cells in suspension culture. Efficiency of editing is assessed by any suitable method such as a heteroduplex cleavage assay or by sequencing, as described elsewhere in this disclosure.

In a non-limiting example, self-assembled Cas9/ArgNP nanoassemblies are prepared as described in Mout et al. (2017) ACS Nano, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are further prepared for Biolistics or particle bombardment and thus delivered to plant cells from suspension cultures transferred to semi-solid or solid media, as well as to rice embryogenic callus. In one variation of the procedure, the Cas9/ArgNP nanoassemblies are co-delivered with at least one guide RNA (such as those described in Examples 3-7) to the plant cells or callus. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the plant cells or callus. Efficiency of editing is assessed by any suitable method such as a heteroduplex cleavage assay or by sequencing, as described elsewhere in this disclosure.

In a non-limiting example, self-assembled Cas9/ArgNP nanoassemblies are prepared as described in Mout et al. (2017) ACS Nano, doi:10.1021/acsnano.6b07600 or alternatively as described in International Patent Application Publication WO2016/123514, by mixing a Cas9 from *Streptococcus pyogenes* modified at the N-terminus with a polyglutamate peptide that includes at least 15 glutamate residues and modified at the C-terminus with a nuclear localization signal (NLS) with cationic arginine gold nanoparticles (ArgNPs). The Cas9/ArgNP nanoassemblies are delivered by infiltration (e. g., using mild positive pressure or negative pressure) into leaves of *Arabidopsis thaliana* plants. In one variation of the procedure, the Cas9/ArgNP nanoassemblies are co-delivered with at least one guide RNA (such as those described in Examples 3-7) to the *Arabidopsis* leaves. In other variations of the procedure, the self-assembled Cas9/ArgNP nanoassemblies are prepared with at least one guide RNA to allow the modified Cas9 to form a ribonucleoprotein (RNP) either prior to or after formation of the nanoassemblies; the self-assembled RNP/ArgNP nanoassemblies are then delivered to the *Arabidopsis* leaves. Efficiency of editing is assessed by any suitable method such as a heteroduplex cleavage assay or by sequencing, as described elsewhere in this disclosure.

One of skill in the art would recognize that alternatives to the above compositions and procedures can be used to edit plant cells and intact plants, tissues, seeds, and callus. In embodiments, nanoassemblies are made using other sequence-specific nucleases (e. g., zinc-finger nucleases (ZFNs), transcription activator-like effector nucleases (TAL-effector nucleases or TALENs), Argonaute proteins, or a meganuclease or engineered meganuclease) which can be similarly charge-modified. In embodiments, nanoassemblies are made using other nanoparticles (e. g., nanoparticles made of materials such as carbon, silicon, silicon carbide, gold, tungsten, polymers, ceramics, iron oxide, or cobalt ferrite) which can be similarly charge-modified in order to form non-covalent complexes with the charge-modified sequence-specific nuclease. Similar nanoassemblies including other polypeptides (e. g., phosphatases, hydrolases, oxidoreductases, transferases, lyases, recombinases, polymerases, ligases, and isomerases) or polynucleotides or a combination of polypeptides and polynucleotides are made using similar charge modification methods to enable non-covalent complexation with charge-modified nanoparticles. For example, similar nanoassemblies are made by complexing charge-modified nanoparticles with one or more polypeptides or ribonucleoproteins including at least one functional domain selected from the group consisting of: transposase domains, integrase domains, recombinase domains, resolvase domains, invertase domains, protease domains, DNA methyltransferase domains, DNA hydroxylmethylase domains, DNA demethylase domains, histone acetylase domains, histone deacetylase domains, nuclease domains, repressor domains, activator domains, nuclear-localization signal domains, transcription-regulatory protein (or transcription complex recruiting) domains, cellular uptake activity associated domains, nucleic acid binding domains, antibody presentation domains, histone modifying enzymes, recruiter of histone modifying enzymes, inhibitor of histone modifying enzymes, histone methyltransferases, histone demethylases, histone kinases, histone phosphatases, histone ribosylases, histone deribosylases, histone ubiquitinases, histone deubiquitinases, histone biotinases, and histone tail proteases.

Example 33

This example illustrates a method of simultaneously effecting multiple modifications in a genome (i. e., multiple modifications of at least one sequence of interest in a genome), comprising introducing at least two DSBs into a genome by one or more nucleases, and, optionally, integrating at least one sequence encoded by a polynucleotide (such as a double-stranded DNA, a single-stranded DNA, a single-stranded DNA/RNA hybrid, or a double-stranded DNA/RNA hybrid) molecule at one or more DSBs. In embodiments, the modifications are effected in two or more sequences or genes of interest. More specifically, this non-limiting example illustrates using multiple different ribonucleoproteins (RNPs), wherein each RNP includes a guide RNA (gRNA) and a nuclease, to effect multiple DSBs in the genome of a monocot plant, and integration of a sequence encoded by a double-stranded DNA (dsDNA) donor molecule at the location of the multiple DSBs. In this example, two endogenous maize (*Zea mays*) sequences or genes of interest, Lc (see Examples 5, 6, 8, and 9) and ADH1 (see Example 3), were selected for modification by insertion of an expression-enhancing element at a DSB located in the promoter region of each gene.

The target genes selected for editing were the maize (*Zea mays*) alcohol dehydrogenase ADH1 (see www[dot]maizegdb[dot]org/gene_center/gene/GRMZM2G442658) with the partial genomic sequence of SEQ ID NO:21 (see Example 3), and the maize (*Zea mays*) Lc gene (see www[dot]maizegdb[dot]org/gene_center/gene/GRMZM5G822829) with the partial promoter sequence of SEQ ID NO:305 (see Example 5).

Ribonucleoproteins (RNPs) were prepared with Cas9 nuclease (Aldevron, Fargo, N. Dak.) and guide RNA complexes. Two guide RNA complexes were made with a crRNA and a tracrRNA (crRNAs and tracrRNA were purchased from Integrated DNA Technologies, Coralville, Iowa); the first guide RNA complex used a crRNA (ZmADH1-B) having the sequence of SEQ ID NO:23 (see Example 3) and the second guide RNA complex used a crRNA (ZmLc-Pro3) having the sequence of SEQ ID NO:334 (see Example 6). An expression-enhancing element in the form of the 34 base-pair dsDNA molecule "3×DR5" (with strands having the sequences of SEQ ID NO:306 and SEQ ID NO:307), which contains three copies of an auxin response element (SEQ ID NO:308), as described in Example 5, was purchased from Integrated DNA Technologies, Coralville, Iowa; each strand was phosphorylated on the 5' end and contained two phosphorothioate linkages at each terminus (i. e., the two linkages between the most distal three bases on either end of the strand).

Maize B73 protoplasts were prepared as described in, e. g., Examples 1, 3, 4, 5, 6, 9, and 10. Following the same general procedures described above (e. g., Examples 3-6, 9-10, and 13-16), the protoplasts were transfected with the RNPs (including the guide RNA complexes), with or without the dsDNA molecule "3×DR5". Transfections were carried out to deliver the same molar quantity of RNP for each genomic locus targeted for modification. Samples transfected with both the RNP containing the ZmADH1-B guide RNA complex and the RNP containing the ZmLc-Pro3 guide complex were thus transfected with twice the amount of nuclease (provided as RNP) as the samples that were transfected with only a single RNP (containing either the ZmADH1-B guide RNA complex or the ZmLc-Pro3 guide complex). Maize protoplasts treated with no nuclease, no guide RNA complex, and no dsDNA served as a null control. The transformed protoplasts were then incubated for about 48 hours in a maize incubation buffer including the herbicide 2,4-dichlorophenoxyacetic acid ("2,4-D"), which has auxin-like properties. Next-generation sequencing (NGS) analysis was used for quantitation of editing efficiency and efficiency of integration of the "3×DR5" sequence into the maize genome. Results are provided in Table 21. Editing efficiency is expressed as the percentage of the total population of cells in which a DSB is correctly induced in the genome, i. e., wherein the DSB is correctly effected at the locus targeted by the crRNA. Insertion efficiency is expressed as the percentage of the total population of cells in which the "3×DR5" sequence is inserted at the correct locus in the genome, i. e., inserted at the locus targeted by the crRNA.

Based on the NGS sequencing results, editing efficiency was nearly 60% (i. e., nearly 60% of the total cell population subjected to the editing treatment) for either of the RNPs used, whether or not the polynucleotide donor molecule was provided. Insertion efficiency was about 21% of the total cell population treated with the single ADH1-B RNP and the "3×DR5" donor (i. e., about 37% of the cells that contained a DSB at the correct locus also contained the "3×DR5" sequence), and about 25% of the total cell population treated with the single Lc-Pro3 RNP and the "3×DR5" donor (i. e., about 44% of the cells that contained a DSB at the correct locus also contained the "3×DR5" sequence). In the case of cells treated with both RNPs and the "3×DR5" donor, insertion efficiency was about 27% at the ADH1 locus and about 29% at the Lc locus. These data demonstrate a consistent over-all editing efficiency of approximately 60% of the total cell population and a consistent over-all insertion efficiency of approximately 25% of the total cell population (which is equivalent to approximately 40% of the cells that contained a DSB at the correct locus). The data indicate that simultaneous multiple modifications (integration of a dsDNA at a DSB in two different genes) in the maize protoplasts' genome was effected at about the same efficiency as a modification in one of the genes individually, as the editing and insertion efficiencies were approximately the same as those observed for modification carried out in an individual gene.

the cells to be microinjected are relatively large (e.g., the egg/synergids/zygote and the central cell). For smaller cells, such as those of the embryo, a compound, inverted microscope with an attached Narashige manipulator is used. Injection pipette diameter and bevel are also important. Use a high quality pipette puller and beveler to prepare needles with adequate strength, flexibility and pore diameter. These will vary depending on the cargo being delivered to cells. The volume of fluid to be microinjected must be exceedingly small and must be carefully controlled. An Eppendorf Transjector yields consistent results (Laurie et al., 1999).

The genetic cargo can be RNA, DNA, protein or a combination thereof. The cargo can be designed to change one aspect of the target genome or many. The concentration of each cargo component will vary depending on the nature of the manipulation. Typical cargo volumes can vary from 2-20 nanoliters. After microinjection the embryos are maintained on sterile MS medium with 10% sucrose. Plantlets are transferred to fresh MS media every two weeks and to larger containers as they grow. Plantlets with a well-developed root system are transferred to soil and maintained in high-humidity for 5 days to acclimate. Plants are gradually exposed to the air and cultivated to reproductive maturity.

Microinjection of corn embryos: The cobs and tassels are immediately bagged when they appear to prevent pollination. To obtain zygote-containing maize embryo sacs, hand pollination of silks is performed when the silks are 6-10 cm

TABLE 21

| RNP | Polynucleotide donor molecule | ADH1 | | | Lc | | |
|---|---|---|---|---|---|---|---|
| | | Editing efficiency | Insertion efficiency | DSB with 3xDR5 insertion | Editing efficiency | Insertion efficiency | DSB with 3xDR5 insertion |
| Null | none | 0 | 0 | 0 | 0 | 0 | 0 |
| ADH1-B | 3xDR5 | 57.17 | 20.94 | 36.6% | 0 | 0 | 0 |
| Lc-Pro3 | 3xDR5 | 0 | 0 | 0 | 59.74 | 24.83 | 41.6% |
| ADH1-B + Lc-Pro3 | none | 55.83 | 0 | 0 | 65.24 | 0 | 0 |
| ADH1-B + Lc-Pro3 | 3xDR5 | 61.58 | 27.13 | 44.1% | 67.73 | 29.31 | 43.3% |

One of skill in the art would recognize that simultaneously effecting multiple DSBs in a genome (e. g., effecting multiple DSBs in a sequence of interest or effecting at least one DSB in each of two or more sequences of interest) can be achieved with alternative methods (e. g., use of CRISPR nucleases other than Cas9, such as CasX, CasY, and Cpf1, zinc-finger nucleases (ZFNs), transcription activator-like effector nucleases (TAL-effector nucleases or TALENs), Argonaute proteins, or a meganuclease or engineered meganuclease) and thus similar embodiments of the approach described herein include use of any of these methods for simultaneously effecting multiple DSBs in a genome, and, optionally, integrating a sequence encoded by at least one polynucleotide molecule at one or more DSBs.

Example 34

As described herein, microinjection techniques can be used as an alternative to the methods for delivering targeting agents to protopolasts as described, e.g., in certain Examples above. Microinjection is typically used to target specific cells in isolated embryo sacs or the shoot apical meristem. See, e.g., U.S. Pat. No. 6,300,543, incorporated by reference herein. For example, an injector attached to a Narashige manipulator on a dissecting microscope is adequate because long, the pollinated ears are bagged and tassels removed, and then ears are harvested at 16 hours later. After removing husks and silks, the cobs are cut transversely into 3 cm segments. The segments are surface sterilized in 70% ethanol and then rinsed in sterile distilled, deionized water. Ovaries are then removed and prepared for sectioning. The initial preparation may include mechanical removal of the ovarian wall, but this may not be required.

Once the ovaries have been removed, they are attached to a Vibratome sectioning block, an instrument designed to produce histological sections without chemical fixation or embedment. The critical attachment step is accomplished using a commercial adhesive such as Locktite cement. Normally 2-3 pairs of ovaries are attached on each sterile sectioning block with the adaxial ovarian surface facing upwards and perpendicular to the longitudinal axis of the rectangular sectioning block (Laurie et al., *In Vitro Cell Dev Biol.*, 35: 320-325, 1999). Ovarian sections (or "nucellar slabs") are obtained at a thickness of 200 to 400 micrometers. Ideal section thickness is 200 micrometers. The embryo sac will remain viable if it is not cut. The sections are collected with fine forceps and evaluated on a dissecting microscope with basal illumination. Sections with an intact embryo sac are placed on semi-solid Murashige-Skoog (MS)

culture medium (Campenot et al., 1992) containing 15% sucrose and 0.1 mg/L benzylaminopurine. Sterile Petriplates containing semi-solid MS medium and nucellar slabs are then placed in an incubator maintained at 26° C. These can be monitored visually by removing plates from the incubator and examining the nucellar slabs with a dissecting microscope in a laminar flow hood.

Example 35

This example illustrates a method of providing a plant cell or plant having a modified phenotype, the method including generating novel alleles by deletion of genome sequences between at least two double-strand breaks (DSBs). In this non-limiting example, multiple DSBs are effected in a maize cell by using multiple ribonucleoproteins (RNPs), each including a nuclease and a guide RNA (gRNA). More specifically, this example illustrates deletion of a microRNA (miRNA) recognition site in a maize gene containing an SPX domain and predicted to be natively regulated at least in part by an endogenous miRNA, thereby decoupling the gene from regulation by the endogenous miRNA. Maize plants containing such a genomic modification are predicted to have increased nitrogen use efficiency, especially under conditions of nitrogen deficiency, compared to plants lacking the genetic modification.

Proteins containing an SPX ("SYG1/Pho81/XPR1") domain have been assigned the protein family identifier Pfam PF03105; see, e. g., pfam[dot]xfam[dot]org/family/SPX. Some SPX proteins are reported to be involved in phosphate uptake/regulation; see, e. g., Wang et al. (2004) *Plant Physiol.*, 135:400-411. More recently, novel maize SPX proteins were reported to contain a miRNA recognition site for a mature miRNA identified from at least *Oryza sativa*, *Zea mays*, and *Glycine max*, with the sequence UUAGAUGACCAUCAGCAAACA (SEQ ID NO:997); this miRNA is similar to miR827 reported from *Arabidopsis thaliana*. In maize, expression of this mature miRNA was reported to be strongly suppressed under nitrogen deficiency relative to expression under nitrogen sufficiency as well as suppressed under phosphate deficiency relative to expression under phosphate sufficiency (see especially FIG. 12 and Examples 7-15 in U.S. Pat. No. 8,946,511, which is incorporated in its entirety by reference herein). Consonant with this, maize and *Arabidopsis* genes containing an SPX domain (the SPX and SPX-MFS domain clades shown in FIG. 12 of U.S. Pat. No. 8,946,511) were reported to be suppressed under nitrogen sufficiency, indicating probable regulation by the miRNA with the sequence UUAGAUGACCAUCAGCAAACA (SEQ ID NO:997).

Maize protoplasts are prepared as described in Example 1. Preparation of reagents, gene editing procedures, and detection of gene modifications are carried out using procedures similar to those described in Examples 13-16. The maize gene selected for modification is GRMZM2G086430 (see Thatcher et al. (2014) *Plant Cell*, 26:3472-3487; see also SEQ ID NO:8767 in U.S. Pat. No. 8,946,511, which is incorporated in its entirety by reference herein); a partial 5' untranslated region (5' UTR) sequence of this gene is:

(SEQ ID NO: 998)
AGCAGCACGGCAGTAGCTGCGCCATTGCACGCCTCCGGCCGGCGGCTGCT

TGTCTTGCTGCTTCTGCCGCACATCCGTGATCCgtacgtcgtcacctcac cactcacgcacaagcacaaagagcgttaatttcttgctggagattctatt -continued ctatttctatggcgtgtccctgatcgaatcctaaatcctaaacctctgtg gtgcactgcagGGCAGAAGGTGCTTCGTTCGTTGCAGGCCTGGCGCCACG

CCGTACCGTGCAAGCGCGTTTGCTGATGTTCATCTAATTACTGTATAATA

ATATCTCCGGGCGAAAGAGCTAGCAATCGTCGGCGGGGAGGAGGGGCTC

GATTGCTGCTCAAGGTGAGTTGTAATTCCTTGGCTCTGGATTTCCCTATC

TGTTGGCTGTTCATGGATCATCCAATGGATGGATGGCGCTCCCTGTTCTC

TACACCTGCGTGCTCTTCTTCCCTCGCCTCGCCGGGGTCTTGTGTCAGTT, with intronic sequence shown in lower-case font and the miRNA recognition site CGTTTGCTGATGTTCATCTAA (SEQ ID NO:999) located at nucleotide positions 267-287 of SEQ ID NO:998 shown in underlined font. Two crRNAs are designed to effect DSBs on either side of the miRNA recognition site, resulting in a 66 base-pair deletion in the genomic sequence; the first crRNA (CAUCAGCAAACGCGCUUGCAGUUUUAGAGCUAUGCU, SEQ ID NO:1000) was designed to effect a DSB at 262 base-pairs downstream of (5' to) the transcription start site (TSS) and the second crRNA (GCGAAAGAGCUAGCAAUCGUGUUUUAGAGCUAUGCU, SEQ ID NO:1001) was designed to effect a DSB at 328 base-pairs downstream of (5' to) the TSS. The crRNAs and tracrRNA are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). The two RNPs are delivered together to the maize protoplasts using procedures similar to those described in Examples 13-16. The resulting partial sequence deletion in non-coding sequence of the SPX gene is expected to decouple the gene's expression from endogenous miRNA regulation, i. e., deregulating SPX expression in response to nitrate sufficient or phosphate sufficient conditions. Similar genomic modification is carried out in maize germline cells using procedures as described in Examples 31-34; the resulting maize plants containing such a genomic modification (decoupling of SPX expression from miRNA regulation) are predicted to have increased nitrogen use efficiency, especially under conditions of nitrogen deficiency.

Transcript levels of SPX is measured by quantitative PCR in the genomically modified protoplasts and in control protoplasts lacking the genomic modification, grown under high nitrate (10 millimolar $KNO_3$) or high phosphate (10 milligrams/liter). To evaluate effects of a similar genomic modification (deletion of the functional miRNA recognition site in the SPX gene) in whole maize plants or seedlings, the plants or seedlings are grown under high (10 millimolar) nitrogen, low nitrogen (0.1 millimolar), high phosphate (10 milligrams/liter), or low phosphate (0.1 milligrams/liter) conditions and biomass is measured. Plants or seedlings in which the SPX gene is modified to decouple its expression from endogenous miRNA regulation are predicted to have increased biomass, especially under conditions of nitrogen deficiency, relative to control plants lacking the genomic modification.

Example 36

This example illustrates a method of providing a plant cell or plant having a modified phenotype, the method including generating alleles having modified epigenetic (i. e., methylation) status. The miniature inverted-repeat transposable element (MITE) insertion found in the promoter region of ZmNAC111 appears to have occurred after maize domestication and spread among temperate germplasm; it is associated with natural variation in maize drought tolerance. Increasing ZmNAC111 expression in transgenic maize enhances drought tolerance at the seedling stage, improves water-use efficiency and induces upregulation of drought-responsive genes under water stress. See, e. g., Mao et al. (2015) *Nature Communications*, DOI: 10.1038/ncomms9326. In this non-limiting example, the MITE insertion in the 5' untranslated region (5' UTR) of the maize NAC111 gene is modified in order to increase ZmNAC111 expression and thereby improve water use efficiency in the maize cell or plant.

The gene to be modified is the maize NAC111 gene (GRMZM2G127379; see Mao et al. (2015) *Nature Communications, DOI:* 10.1038/ncomms9326), which has a promoter sequence (i. e., the 600 contiguous nucleotides located immediately upstream of the NAC111 transcription start site) given by:

```
                                     (SEQ ID NO: 1002)
ttctccataaaaaagttgagctaaacagccccctaaagtatatgtagata agcacgattctagtactaaccgcaggacttcttgagcagagcaaaagatg gaTACTCCCTCCGTTTCTTTTTATTAGTCGCTGGATAGTGCAATTTTGCA CTATCCAGCGACTAATAAAAAGAAACGGAGGGAGTAttaattacagaaga actgacggggcgcatggtttccacgaggtgggcgcaccccggccacatgc atcggcgaaaacaaaatggcagtcgcgaatcgaaagctgccaagctaggc cgcatgctggggatgtgtgacacacatatcattggcggtcatggcaggtc gacacgtgtaggcggacgtcatccatcgtcttcatccctatctatctatc tatcactcagtacaagccattgctttcgttatcttccgaggcgggcaggg cagggcaggttcttcccccttggcacgcaccgcacgcacggcttgcgtg gagccaggccagctcgacgatgactacgcggccccggcccgcggcccag tcctccctcctcttcgatcctataaaagcgaggcccagtccctccatctc,
``` with the MITE sequence located at nucleotide positions 103-186 of SEQ ID NO:1002 (i. e., 414-498 base-pairs upstream of the NAC111 transcription start site) and indicated by upper case font.

In one approach, the MITE sequence is deleted or made non-functional by effecting at least one DSB in the MITE sequence. Two crRNAs are designed to effect DSBs on either side of the MITE sequence, resulting in deletion of the MITE sequence; the first crRNA (GCUCUGCUCAAGAAGUCCUGGUUUUAGAGCUAUGCU, SEQ ID NO:1003) was designed to effect a DSB 525 base-pairs upstream of the transcription start site (TSS) and the second crRNA (UAAUUACAGAAGAACUGACGGUUUUAGAGCUAUGCU, SEQ ID NO:1004) was designed to effect a DSB at 396 base-pairs upstream of the TSS. The crRNAs and tracrRNA are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). The two RNPs are delivered together to the maize protoplasts using procedures similar to those described in Examples 13-16. The resulting partial sequence deletion in non-coding sequence of the ZmNAC111 gene is expected to result in upregulation of ZmNAC111 expression. Similar genomic modification is carried out in maize germline cells using procedures as described in Examples 31-34; the resulting maize plants containing such a genomic modification (deletion of the MITE sequence) are predicted to have increased water use efficiency (measured, e. g., by comparison of biomass or of seed yield of plants grown under different water availability regimes) and therefore enhanced drought tolerance.

In another approach, the MITE sequence is modified by targeted demethylation, e. g., using guide RNAs and a catalytically deactivated Cas9 ("dCas9") fused to the demethylation enzyme TET1 (a 5-methylcytosine hydroxylase). Constructs encoding a modified dCas9-SunTag and an anti-GCN4 scFv fused to ten-eleven hydroxylase 1 (TET1), as described in detail by Morita et al. (2016) *Nature Biotechnol.*, 34:1060-1065; doi: 10.1038/nbt.3658), are used to demethylate the ZmNAC111 MITE region; these plasmids are publicly available from Addgene (see www[dot]addgene[dot]org/browse/article/22324/). Two crRNAs targeting the MITE region in the promoter of ZmNAC111 were designed to bring TET1 to MITE region and trigger demethylation; the first crRNA (GCUCUGCUCAAGAAGUCCUGGUUUUAGAGCUAUGCU, SEQ ID NO:1003) was designed to target 508-528 base-pairs upstream of the transcription start site (TSS) and the second crRNA (CAGCGACUAAUAAAAAGAAAGUUUUAGAGCUAUGCU, SEQ ID NO:1005) was designed to target 425-445 base-pairs upstream of the TSS. The crRNAs and tracrRNA are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). The two RNPs are delivered together with the dCas9-SunTag and anti-GCN4 scFv/TET1 fusion plasmids to the maize protoplasts using procedures similar to those described in Examples 13-16. The resulting demethylation of the MITE region of the ZmNAC111 gene is expected to result in upregulation of ZmNAC111 expression. Similar genomic modification is carried out in maize germline cells using procedures as described in Examples 31-34; the resulting maize plants containing such a genomic modification (demethylation of the MITE sequence) are predicted to have increased water use efficiency (measured, e. g., by comparison of biomass or of seed yield of plants grown under different water availability regimes) and therefore enhanced drought tolerance.

Example 37

This example illustrates a method of providing a plant cell or plant having a modified phenotype, the method including generating novel alleles having a modified amino acid sequence. In this non-limiting example, homology-dependent repair (HDR) is employed to effect amino acid changes in genomic sequence of an abscisic acid (ABA) receptor in maize, ZmPYL-E, that render the modified ZmPYL-E hypersensitive to ABA. See, e. g., U.S. Patent Application Publication 2016/0194653, which is incorporated by reference in its entirety herein. Maize cells and plants containing such a genomic modification are predicted to show hypersensitivity to ABA and increased water use efficiency compared to plants lacking the genetic modification.

The HDR approach described here uses the novel approach of delivering the HDR template as a component of the Cas9/gRNA complex directly to double-strand breaks (DSBs) precisely effected in the genome of cells. In embodiments, the HDR template/Cas9/gRNA complex is delivered to germline cells (or cells that give rise to germline cells), avoiding the need for tissue culture and resulting in the intended genome modification being heritable to subsequent generations of plants.

The target gene is ZmPYL-E; genomic sequence for this gene is given by:

(SEQ ID NO: 1006)
atggtgggtctcgtcggcggcagcacggcgcgggcggagcacgtcgtcgc caacgccggaggggaggcagagtacgtgcgccgcatgcaccgccacgcgc cgaccgagcaccagtgcacctccaccctcgtcaagcacatcaaggcgccc gtccacctcgtatgtccccctccaccccgctctttcctaccctcaacgc ggctggccccggtggttcagcggttggactgcctcgcgtctgggctgcta tttctcttcggatctggagtcaggagtccttcgtccgatttccaaggcct tgttgggtgtctcccccccaccgacgtgttctcgtgatgttgggttaatc gcggctggcgtcaaatcgattggaagctgacgccgtcgatcgcatcgcag gtgtgggagctggtgcggaggttcgaccagccgcagcggtacaagccgtt cgtcaggaactgcgtcgtgcgcggggaccagctcgaggtcggcagcctgc gcgacgtcaacgtcaagaccggcctgccggcgacgaccagcaccgagcgc ctcgagcagctcgacgacgacctgcacatactcggtgtcaagttcgtcgg cggggaccaccgcctccaggtccgtgctgctgccgcccgtttgttgcgtc cctgcaaaaatgctctgtttcacgcgcctccttgcttgtcagtgtactc caaattattttggggtatgcttgctttgttaccatttctcttttttt aaattaaattgcttcttgtttccatttcactgcagtcctgatcgctgga tgctatgcatgaaatgcatttgctgtgcttgcgagattgggcatttacta tgagctttgtgacagttaacatcttggtcctgtttggaagctgggattgg gaatcaaatccttacatggtttaggagcatccagtttgaacttaaaccat tgtagacatctgctgcaataaaaacaattggcttcggtgagaggcactca tcatcagttcaaacttaaaacgagataagccatcggttgattggcctaat taccttgcttcccgtgattgttcgcctcgctgaaaggatatgctcacaac ccgtactgttttgacttgttatccacatactatttaagtacgaaaggaca tgcgtactactttcatttgttgttcttcgtctagtcttcagactgataat ataaggtgaaaaacttcgatgtttcgcgtgctgtcaagtgattgtgaagc aaagtttctgttagtgtcaatgcgtacaggctgcaatggccatctttact cctacttgaagcatatctctgatccacactgatgatgatgagttgtgtgc gccactttttttcttttctttcagaactactcatccatcataactgtc caccccgagagcattgacgggaggccgggcaccctggtgatcgagtcgtt cgtggtcgatgtgcctgatggcaacacgaaggacgagacatgctacttcg tggaggccgtgatcaagtgcaacctcaattctctcgcagaggtatcggag cagctagcagtggagtcacctacgtcgctgatcgatcagtga and a cDNA sequence is given by:

(SEQ ID NO: 1007)
ATGGTGGGTCTCGTCGGCGGCAGCACGGCGCGGGCGGAGCACGTCGTCGC

CAACGCCGGAGGGGAGGCAGAGTACGTGCGCCGCATGCACCGCCACGCGC

CGACCGAGCACCAGTGCACCTCCACCCTCGTCAAGCACATCAAGGCGCCC

GTCCACCTCGTGTGGGAGCTGGTGCGGAGGTTCGACCAGCCGCAGCGGTA

CAAGCCGTTCGTCAGGAACTGCGTCGTGCGCGGGGACCAGCTCGAGGTCG

GCAGCCTGCGCGACGTCAACGTCAAGACCGGCCTGCCGGCGACGACCAGC

ACCGAGCGCCTCGAGCAGCTCGACGACGACCTGCACATACTCGGTGTCAA

GTTCGTCGGCGGGGACCACCGCCTCCAGAACTACTCATCCATCATAACTG

TCCACCCCGAGAGCATTGACGGGAGGCCGGGCACCCTGGTGATC<u>GAG</u>TCG

TTCGTGGTCGATGTGCCTGATGGCAACACGAAGGACGAGACATGCTACTT

CGTGGAGGCCGTGATCAAGTGCAACCTCAATTCTCTCGCAGAGGTATCGG

AGCAGCTAGCAGTGGAGTCACCTACGTCGCTGATCGATCAGTGA, which encodes the native amino acid sequence MVGLVGG-STARAEHVVANAGGEAEYVRRMHRHAPTEHQCT-STLVKHIKAPVHLVWELVRRFD QPQRYKPFVRNCVVRGDQLEVGSLRDVNVKTGL-PATTSTERLEQLDDDLHILGVKFVGGDHRL QNYS-SIITVHPESIDGRPGTLVIESFVVDVPDGNTKDET-CYFVEAVIKCNLNSLAEVSEQLAVESPT SLIDQ (SEQ ID NO:1008); the three nucleotides (GAG) encoding the glutamic acid residue at position 149 in the polypeptide is indicated by underlined font in the cDNA sequence.

In one approach, a ABA-hypersensitive ZmPLY-E allele is designed to have an amino acid change of E149L, i. e., glutamic acid (E) to leucine (L) at position 149 in the ZmPyl-E polypeptide. A non-limiting embodiment includes changing the codon encoding the amino acid at position 149 from GAG to CTG. A cDNA encoding the hypersensitive ZmPYL-E allele with the E149L mutation has the sequence (SEQ ID NO: 1009)
ATGGTGGGTCTCGTCGGCGGCAGCACGGCGCGGGCGGAGCACGTCGTCGC

CAACGCCGGAGGGGAGGCAGAGTACGTGCGCCGCATGCACCGCCACGCGC

CGACCGAGCACCAGTGCACCTCCACCCTCGTCAAGCACATCAAGGCGCCC

GTCCACCTCGTGTGGGAGCTGGTGCGGAGGTTCGACCAGCCGCAGCGGTA

CAAGCCGTTCGTCAGGAACTGCGTCGTGCGCGGGGACCAGCTCGAGGTCG

GCAGCCTGCGCGACGTCAACGTCAAGACCGGCCTGCCGGCGACGACCAGC

ACCGAGCGCCTCGAGCAGCTCGACGACGACCTGCACATACTCGGTGTCAA

GTTCGTCGGCGGGGACCACCGCCTCCAGAACTACTCATCCATCATAACTG

TCCACCCCGAGAGCATTGACGGGAGGCCGGGCACCCTGGTGATCCTGTCG

TTCGTCGTCGATGTGCCTGATGGCAACACGAAGGACGAGACATGCTACTT

CGTGGAGGCCGTGATCAAGTGCAACCTCAATTCTCTCGCAGAGGTATCGG

AGCAGCTAGCAGTGGAGTCACCTACGTCGCTGATCGATCAGTGA.

A single-guide RNA (sgRNA) including the sequence of CCUGGUGAUC<u>GAG</u>UCGUUCG (SEQ ID NO:1010) is designed to effect a double-strand break (DSB) close to the nucleotides encoding the codon at position 149; the complete sgRNA sequence is given by (SEQ ID NO: 1011)
CCUGGUGAUCGAGUCGUUCGguuuuagagcuagaaauagcaaguuaaaau aaggcuaguccguuaucaacuugaaaaaguggcaccgagucggugcuuuu uuGUCGACGGUAUCGAUAAGCUUGAUAUCGAAUUC, which includes a 33-nucleotide RNA extension (indicated by underlined upper-case font and having the sequence GUCGACGGUAUCGAUAAGCUUGAUAUCGAAUUC (SEQ ID NO:1012)) to the 3' end of the sgRNA that acts as a tether to non-covalently link the Cas9/sgRNA complex by RNA:DNA duplex formation with a DNA donor molecule with homology arms that acts as an HDR template for editing the ZmPyl-E gene to effect the E149L amino acid change. This HDR template has the sequence (SEQ ID NO: 1013)
GACGGGAGGCCGGGCACCCTGGTGATCCTGTCGTTCGTCGTCGATGTGCC

TGATGGCAACACGAAGGAATTCGATATCAAGCTTATCGATACCGTCGAC which includes a 33-nucleotide DNA extension (indicated by underlined upper-case font and having the sequence GAATTCGATATCAAGCTTATCGATACCGTCGAC (SEQ ID NO:1014)), which is complementary to and will bind with the tether extension on the sgRNA. The HDR template encodes the E149L codon substitution and in addition encodes a mutation in the valine 152 codon which destroys the PAM site and prevents further cleavage by Cas9.

In various embodiments, tether sequences are used to complex NHEJ or HDR polynucleotide donor molecules to a RNA-guided nuclease (e. g., a type II Cas nuclease, a Cas9, a type V Cas nuclease, a Cpf1, a CasY, a CasX, a C2c1, or a C2c3). Embodiments of polynucleotide donor molecules include single- or double-stranded RNA or DNA or RNA/DNA hybrids, which can be up to several thousand nucleotides in length and include a tether complementary sequence. To assemble the complex, equal-molar amounts of sgRNA and polynucleotide donor molecule are mixed and heated to 95 degrees Celsius for 5 minutes, then removed from the heat and allowed to cool to room temperature. The appropriate amount of Cas9 is then added to sgRNA:donor complex and incubated at room temperature for 5 minutes.

In embodiments, the Cas9:sgRNA:donor complex is delivered to maize cells by microinjection (e. g., into 1-3 days-after-pollination zygotes), electroporation (e. g., into 9-12 days-after-pollination zygotes), or bombardment or Biolistics (e. g., into 9-12 days-after-pollination zygotes). Biolistic delivery of RNPs to maize embryos is carried out using procedures similar to those described by Svitashev et al. (2016) *Nature Communications*, doi:10.1038/ncomms13274. The microinjection approach is described in Example 34. The electroporation approach is similar to techniques useful in wheat; see, e. g., T. Hagio (2009) "Direct Gene Transfer into Plant Mature Seeds via Electroporation After Vacuum Treatment." In: Electroporation and Sonoporation in Developmental Biology, edited by H. Nakamura, Springer, Japan, doi:10.1007/978-4-431-09427-2_25; and Klöt et al. (1993) *Plant Cell Reports*, 12:671-75, doi:10.1007/BF00233417. This method can be applied to excised 9-12 days-after-pollination embryos or partially germinated seed. Briefly, 20 seed are placed in germination buffer (0.2% polyvinylpyrrolidone (PVP), 0.001% active chlorine) in the dark at 10 degrees Celsius for 3 days. The seed are then transferred to electroporation buffer (0.25% polyvinylpyrrolidone (PVP), 0.15% Tween 20, 5 millimolar spermidine, 0.5% Cellulase (Onozuka RS), 0.125 molar calcium chloride dihydrate) containing the ZmPYL-E RNP complex described above. The mixture is placed under vacuum (0.9 Bar) for 3 hours at room temperature (22 degrees Celsius). The seed are then placed in a 1-1.5 centimeter electroporation cuvette with the scutellum facing the positive electrode and submerged in electroporation buffer. An electronic pulse is delivered using a BTX Gemini X2 waveform generator (square waves, 75 volts, 50 millisecond pulse duration, 10 pulses/second, 100 pulses) one to three times. The seed are returned to germination medium and cultured in the dark at 26 degrees Celsius for 48 hours. Individual seed are then processed to evaluate the presence or absence of the intended edit.

One procedure for assaying successful introduction of the ZmPYL-E hypersensitive allele is to measure the endogenous maize Rab17 (ZmRab17) transcript level. The ZmRab17 steady-state transcript level in plants possessing a hypersensitive ZmPYL-E allele is expected to be higher than that in plants lacking a hypersensitive ZmPYL-E allele; see, e. g., Buchanan et al. (2004) *Genetics*, 168: 1639-54. doi: 10.1534/genetics.104.030346. Maize plants with a ZmPYL-E hypersensitive allele are predicted to exhibit increased water use efficiency, e. g., such plants will produce more biomass per unit water transpired when compared to plants that lack this allele; see, e. g., Medrano et al. (2015) *The Crop J.*, 3: 220-28, doi:10.1016/j.cj.2015.04.002.

Example 38

This example illustrates a method of providing a plant cell or plant having a modified phenotype, the method including generating novel alleles having a modified amino acid sequence. In this non-limiting example, homology-dependent repair (HDR) is employed to insert heterologous promoter sequence upstream of the transcription start site (TSS) of a cytochrome P450 gene, resulting in tissue-specific increased expression of that gene. Maize cells and plants containing such a genomic modification are predicted to show increased biomass and seed yield, in comparison to plants lacking the genomic modification.

The target gene is ZmPLA1 (PLASTOCHRON1, GRMZM2G167986), a cytochrome P450 (CYP78A1), which extends the duration of cell division. Constitutive transgenic expression of ZmPLA1 in maize using a ubiquitin promoter resulted in plants with very large leaves but which failed to reproduce; in contrast, localized transgenic expression of ZmPLA1 in maize using a maize GA2-oxidase (ZmGA2ox, GRMZM2G031724) promoter resulted in increased leaf size, increased biomas, and increased seed yield; see, e. g., Sun et al. (2017) *Nature Communications*, 8:14752; DOI: 10.1038/ncomms14752.

A partial genomic sequence of ZmPLA1 is provided as:

(SEQ ID NO: 1015)
attaactagtgctgataatatatttacactgtagattttttccgataagta gaaaccaaatatttcaccgccacaaaaggcttcatcccatcagttaccca tgtagcaaaaccaaaatacttgtgtgcgagaggccaagagcccaaaccac cgccaaggaaaccccagcccaccaggcgccttcctctataaatacccta actccggtggccgaagttcctcACCCATTCACTCACTCATCTCAAGGCCT

AGGTAGCACCGTAGCAGCTACTAGAAGCAGCTAGCCAGAACAACTCGTCC;

promoter sequence is indicated by lower-case font and 5' untranslated region (5' UTR) indicated by upper case font.

Three crRNAs targeting this region upstream of the ZmPLA1 TSS were designed effect double-strand breaks (DSBs) upstream or slightly downstream of the TSS; the first crRNA (UGGGAUGAAGCCUUUUGUGGGUUUUA-GAGCUAUGCU, SEQ ID NO:1016) was designed to effect a DSB 150 base-pairs upstream of (5' to) the transcription start site (TSS), the second crRNA (CCAAAAUACUUGU-GUGCGAGGUUUUAGAGCUAUGCU, SEQ ID NO:1017) was designed to effect a DSB 95 base-pairs upstream of the TSS, and the third crRNA (CCAAAAUA-CUUGUGUGCGAGGUUUUAGAGCUAUGCU, SEQ ID NO:1018) was designed to effect a DSB 19 base-pairs downstream of (3' to) the TSS. The sequence to be inserted at a DSB was a 2,046-bp promoter sequence of the maize GA2-oxidase (Sun et al. (2017) *Nature Communications*, 8:14752; DOI: 10.1038/ncomms14752):

```
                                              (SEQ ID NO: 1019)
GAGGATTGCAGCTCCTGGATCATATCAGAATGTCTGTCGCTCGCCACCCC

GGGCGCACTGCATTATATTTCTGGCAGGTGCGCAATACAATATGGCATGG

GGGGCACGTAGTACGGTACTGCCGTACAGCTGCGTCAGCAAATGCCAACT

TGTGTGGTACAGCTATAATCTATAGAAAAAGAATATTATAGAAGTAGTA

GAAGTTGGCGCGTATGGATTAAGGAAGGTTTGGTTTCTAGTGACTAATTT

AGTCTCTCTATTTTATTCAATTTTGTTCCTAAATTATCAAACTAAAATGA

AGTTTTGTTTTTTTATATAGGATAATTTAGAGACTAAAATAGAATAAAA

ATGAATGGATGAAAAATTAGTTCCTACCAACCAAACACCCCTTAAGAGCT

ACTTCGAGAACCTCAAATCTCCTTCGAGACTGGAGGAGATGAAGGTAAAA

ATAAACTAATTTTCCCTTCAATCCTTTTAATTCACAAGGGGTGCGGGTA

CGGAAATGTTTACTACTATACTGGAAAGGTGTCTGAAACCGGGAGAAAAG

CTTTGACCAGGGTGGACCTGTTTATGGGATCGAAGCGGCCGTTGCCCCAA

CTGGCGACTGGCGAGCCACCATTGCGCGGACCCGAGATTAACTATACTAC

AGGAGTACTGTCGGGTTGGTACCAATACGTGGCTTGGGCAAAAAGTCTGG

CAGGCGCCGCTGCTTGTCTGCGGTTTCTATGTGCCGATGCCATCGCACCG

GACCGGATCGGGATGGGATCAGCGGAACATGCGAGAGCGAGCCTGCACTG

CACTGCATGGCCGCGACCGCGTCGTCCATCGAGCCGCCTATCATTAGTTG

GTTCCACTGTCTCGCCGCCGAAGCAAGGCAGCACAGCACACATCAGCATT

GCTTCCCAGTTCCCAATGCCCCGTCGTCCTAGCCGAGGCGGGCTCAGTAC

CAACCCAGCTGAAACTACGAGAGATGCGCTGTGGGCAGGACAGTGGTCGA

GCGAGGAGTGTACCTGTAGTTAACGAGGATTTTATTTTACTAGTGCGTAC

GTACGTACTGTACGTACTATGATCTCTCACGTGCTCTGGTCTTATCACTC

GCTTGATTATACTATGATCTTTTTTTCCCTCCACCTGCTCTGGTCTTATC

GCTGGCACGTGCTTTTACACGGCCACTTAGGACTACTCACCTCGTCTCGT

CATGCTTATCTACTTCAGAGCGTCACGGACACAGCAAGGAGGAGTACGCA

CACGCAGCATGGACTGCCTGGAGCGGGGTGTGGTGCACTAACGCCCGCCT

AATTCCCGGAGCTGCCTGTGCCTTGGACGCCCATCTCTGGTTTCGCGGGG

AGAATAATAATAATTTAGGCGAAACACGGGAACGGGTCGTGAGGAAAAGC
```

```
                 -continued
CTGACATGCTGCATTACGGCCGGTGCCGTTCGGACCCCAGTTATTGATGA

GCCGAGTCACCGACCTGCCAAGAAAAGGATGCCGGATCAAGGGCAGGTTC

ACCTCATCTTAGCGCATGCAAGCGTCGTCCCTAACCAAAACATCATCTTC

ATGTCTGGCCGCCCGCGCAGCGGTCCCAGTGCCGGCGTGGTTAACGGGAG

GGACTGGGACTGGCAGGGCCGGCTAATGGCCGACGTGCAGTCGCCTCGTA

TGCGTTTCCCGTTGAGCCATGCATGCAGCAGAGCAGCGCGGGCGGCCGGT

CCTGCCACCGGTGGATCGCGGCCGGGCACGTCACGGCCCGGTCCCCGACT

GCTCTGGCTCCATCGCCGCCACCATGCACCCAAAGCGATCCACCCCCGAT

GCATCCCTTTTCTCTCCCTGTCAGCTGGGCCCATCTCGCGTCACCGTAGC

CAGGTGCCGCCCCGTCGCCCCGCCCCCCGATCTATATATGCTGCCCACGG

GCTCTCCCACTTCTCCCCCACATGCACTTGCTGCAGCAGCCGTAGGACAC

ACGCACACCGCCTCGACCTCGAGTCCACCACTGACTCCACCACCTCCCCC

TGTTTTTTTTCGACCTCGCTCTGCTCATCCGCACGGCCAGACAGCC.
```

Polynucleotide (such as a double-stranded DNA, a single-stranded DNA, a single-stranded DNA/RNA hybrid, or a double-stranded DNA/RNA hybrid) donor molecules are designed including the ZmGA2ox promoter (SEQ ID NO:1019) with the addition of homology arms (generally including about 50 to about 1000 nucleotides having sufficient sequence identity or complementarity to the genomic sequence flanking the site of the DSB) on one or on both sides of the promoter sequence to facilitate HDR-type integration of the donor sequence at the site of the DSB. The crRNAs, tracrRNA, and donor polynucleotides are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). Each individual RNP is delivered together with GA2ox promoter donor molecule to maize protoplasts using procedures similar to those described in Examples 13-16. Integration of the heterologous promoter is expected to result in localized upregulation of ZmPLA1 expression. Similar genomic modification is carried out in maize germline cells using procedures as described in Examples 31-34; the resulting maize plants containing such a genomic modification (operably linking the ZmGA2ox promoter to ZmPLA1) are predicted to have increased leaf area, increased biomass, and/or increased seed yield, compared to plants lacking the genomic modification. Growth chamber and field assays for measuring leaf area, biomass, or seed yield are described in detail in Sun et al. (2017) *Nature Communications*, 8:14752; DOI: 10.1038/ncomms14752.

Example 39

This example describes the modification of four genes in a maize cell or plant to provide increased nitrogen use efficiency (NUE).

An increase in expression of NRT2.2 (Zm00001d054060) is predicted to increase nitrogen use efficiency. A partial genomic sequence of NRT2.2 is provided as SEQ ID NO:381. A nitrogen responsive element sequence encoded by a polynucleotide (such as a double-stranded DNA, a single-stranded DNA, a single-stranded DNA/RNA hybrid, or a double-stranded DNA/RNA hybrid) is inserted upstream of the transcription start site (TSS) of the NRT2.2 coding region at a double-strand break effected between nucleotides at positions 101/102 of SEQ ID NO:381 in order to enhance the expression of NRT2.2. The nitrogen responsive element (AtNRE, see Examples 9, 13, and 16) is encoded by a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i. e., the two linkages between the most distal three bases on either end of the strand). A NRT2.2 crRNA with the sequence of SEQ ID NO:397 is designed to target the nucleotides shown in bold italic in SEQ ID NO:381 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the NRT2.2 gene is carried out using procedures similar to those described in Examples 13-16. Similar genomic modification is carried out in maize germline cells using procedures as described in Examples 31-34; the resulting maize plants containing such a genomic modification are predicted to have increased nitrogen use efficiency.

An increase in expression of NRT2.2 and GLN1.4 (Zm00001d051804) simultaneously is predicted to further increase nitrogen use efficiency. A partial genomic sequence of GLN1.4 is provided as SEQ ID NO:382. A nitrogen responsive element sequence encoded by a polynucleotide (such as a double-stranded DNA, a single-stranded DNA, a single-stranded DNA/RNA hybrid, or a double-stranded DNA/RNA hybrid) donor molecule is inserted upstream of the transcription start site (TSS) of the GLN1.4 coding region at a double-strand break effected between nucleotides at positions 115/116 of SEQ ID NO:382 in order to enhance the expression of GLN1.4. The NRE is provided as a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i. e., the two linkages between the most distal three bases on either end of the strand). A GLN1.4 crRNA with the sequence of SEQ ID NO:398 is designed to target the nucleotide shown in bold italic in SEQ ID NO:382 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the GLN1.4 gene is carried out using procedures similar to those described in Examples 13-16. Similar genomic modification is carried out in maize germline cells using procedures as described in Examples 31-34; the resulting maize plants containing such a genomic modification are predicted to have increased nitrogen use efficiency.

An increase in expression of NRT2.2, GLN1.4, and Dof1 (Zm00001d031278) simultaneously is predicted to even further increase nitrogen use efficiency. A partial genomic sequence of Dof1 is provided as SEQ ID NO:383. Constitutive overexpression of Dof1 has been shown to result in increased photosynthesis under low nitrate conditions in rice (DOI: 10.1111/j.1467-7652.2011.00592.x). In this embodiment the expression of Dof1 is modified to be constitutively expressed by inserting a constitutive enhancer sequence. A maize OCS homologue (see Examples 8 and 16) encoded by a chemically modified single-stranded DNA with the sequence of SEQ ID NO:343 (Integrated DNA Technologies, Coralville, Iowa), phosphorylated on the 5' end and containing two phosphorothioate linkages at each terminus (i. e., the two linkages between the most distal three bases on either end of the strand), is designed for insertion upstream of the transcription start site (TSS) of the Dof1 coding region at a double-strand break effected between nucleotides at positions 101/102 of SEQ ID NO:383 in order to enhance the expression of Dof1. A Dof1 crRNA with the sequence of SEQ ID NO:399 is designed to target the nucleotides shown in bold italic in SEQ ID NO:383 (Table 16); crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the maize OCS homologue sequence into the Dof1 gene is carried out using procedures similar to those described in Examples 13-16. Similar genomic modification is carried out in maize germline cells using procedures as described in Examples 31-34; the resulting maize plants containing such a genomic modification are predicted to have increased nitrogen use efficiency.

An increase in expression of NRT2.2, GLN1.4, Dof1, and an SPX domain-containing gene simultaneously is predicted to even further increase nitrogen use efficiency. The maize SPX domain-containing gene selected for modification is GRMZM2G086430. A partial 5' untranslated region (5' UTR) sequence of this gene is provided as SEQ ID NO:998. The miRNA recognition site is located at nucleotide positions 267-287 of SEQ ID NO:998. Two crRNAs are designed to effect DSBs on either side of the miRNA recognition site, resulting in a 66 base-pair deletion in the genomic sequence; the first crRNA with the sequence of SEQ ID NO:1000 is designed to effect a DSB at 262 base-pairs downstream of (5' to) the transcription start site (TSS) and the second crRNA with the sequence of SEQ ID NO:1001 is designed to effect a DSB at 328 base-pairs downstream of (5' to) the TSS. The crRNAs and tracrRNA are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). The two RNPs are delivered together to the maize protoplasts using procedures similar to those described in Examples 13-16. The resulting partial sequence deletion in non-coding sequence of the SPX gene is expected to decouple the gene's expression from endogenous miRNA regulation, i. e., deregulating SPX expression in response to nitrate sufficient or phosphate sufficient conditions. Similar genomic modification is carried out in maize germline cells using procedures as described in Examples 31-34; the resulting maize plants containing such a genomic modification (decoupling of SPX expression from miRNA regulation) are predicted to have increased nitrogen use efficiency, especially under conditions of nitrogen deficiency.

Example 40

This example describes the modification of two maize genes to improve water use efficiency and to increase biomass and seed yield in a maize cell or plant.

An increase in expression of NAC111 is predicted to improve water use efficiency. The MITE insertion in the 5' untranslated region (5' UTR) of the maize NAC111 gene is modified in order to increase ZmNAC111 expression. The promoter sequence of NAC111 is provided as SEQ ID NO:1002, with the MITE sequence located at nucleotide positions 103-186 of SEQ ID NO:1002 (i. e., 414-498 base-pairs upstream of the NAC111 transcription start site).

In one approach, the MITE sequence is deleted or made non-functional by effecting at least one DSB in the MITE sequence. Two crRNAs are designed to effect DSBs on either side of the MITE sequence, resulting in deletion of the MITE sequence; the first crRNA with the sequence of SEQ ID NO:1003 is designed to effect a DSB 525 base-pairs upstream of the transcription start site (TSS) and the second crRNA with the sequence of SEQ ID NO:1004 is designed to effect a DSB at 396 base-pairs upstream of the TSS. The crRNAs and tracrRNA are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). The two RNPs are delivered together to the maize protoplasts using procedures similar to those described in Examples 13-16. The resulting partial sequence deletion in non-coding sequence of the ZmNAC111 gene is expected to result in upregulation of ZmNAC111 expression. Similar genomic modification is carried out in maize germline cells using procedures as described in Examples 31-34; the resulting maize plants containing such a genomic modification (deletion of the MITE sequence) are predicted to have increased water use efficiency (measured, e. g., by comparison of biomass or of seed yield of plants grown under different water availability regimes) and therefore enhanced drought tolerance.

In another approach, the MITE sequence is modified by targeted demethylation. Constructs encoding a modified dCas9-SunTag and an anti-GCN4 scFv fused to ten-eleven hydroxylase 1 (TET1), as described in detail by Morita et al. (2016) Nature Biotechnol., 34:1060-1065; doi: 10.1038/nbt.3658), are used to demethylate the ZmNAC111 MITE region; these plasmids are publicly available from Addgene (see www[dot]addgene[dot]org/browse/article/22324/). Two crRNAs targeting the MITE region in the promoter of ZmNAC111 were designed to bring TET1 to MITE region and trigger demethylation; the first crRNA with the sequence of SEQ ID NO:1003 is designed to target 508-528 base-pairs upstream of the transcription start site (TSS) and the second crRNA with the sequence of SEQ ID NO:1005 is designed to target 425-445 base-pairs upstream of the TSS. The crRNAs and tracrRNA are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). The two RNPs are delivered together with the dCas9-SunTag and anti-GCN4 scFv/TET1 fusion plasmids to the maize protoplasts using procedures similar to those described in Examples 13-16. The resulting demethylation of the MITE region of the ZmNAC111 gene is expected to result in upregulation of ZmNAC111 expression. Similar genomic modification is carried out in maize germline cells using procedures as described in Examples 31-34; the resulting maize plants containing such a genomic modification (demethylation of the MITE sequence) are predicted to have increased water use efficiency (measured, e. g., by comparison of biomass or of seed yield of plants grown under different water availability regimes) and therefore enhanced drought tolerance.

An increase in expression of NAC111 and an increase in expression of PLA1 simultaneously is predicted to result in improved water use efficiency, increased leaf size, increased biomass, and increased seed yield. A partial genomic sequence of ZmPLA1 is provided as SEQ ID NO:1015. Three crRNAs targeting this region upstream of the ZmPLA1 TSS were designed effect double-strand breaks (DSBs) upstream or slightly downstream of the TSS; the first crRNA with the sequence of SEQ ID NO:1016 is designed to effect a DSB 150 base-pairs upstream of (5' to) the transcription start site (TSS), the second crRNA with the sequence of SEQ ID NO:1017 is designed to effect a DSB 95 base-pairs upstream of the TSS, and the third crRNA with the sequence of SEQ ID NO:1018 is designed to effect a DSB 19 base-pairs downstream of (3' to) the TSS. The sequence to be inserted at a DSB was a 2,046-bp promoter sequence of the maize GA2-oxidase with the sequence of SEQ ID NO:1019. Polynucleotide (such as a double-stranded DNA, a single-stranded DNA, a single-stranded DNA/RNA hybrid, or a double-stranded DNA/RNA hybrid) donor molecules are designed including the ZmGA2ox promoter (SEQ ID NO:1019) with the addition of homology arms (generally including about 50 to about 1000 nucleotides having sufficient sequence identity or complementarity to the genomic sequence flanking the site of the DSB) on one or on both sides of the promoter sequence to facilitate HDR-type integration of the donor sequence at the site of the DSB. The crRNAs, tracrRNA, and donor polynucleotides are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). Each individual RNP is delivered together with GA2ox promoter donor molecule to maize protoplasts using procedures similar to those described in Examples 13-16. Integration of the heterologous promoter is expected to result in localized upregulation of ZmPLA1 expression. Similar genomic modification is carried out in maize germline cells using procedures as described in Examples 31-34; the resulting maize plants containing such a genomic modification (operably linking the ZmGA2ox promoter to ZmPLA1) are predicted to have increased leaf area, increased biomass, and/or increased seed yield, compared to plants lacking the genomic modification. Growth chamber and field assays for measuring leaf area, biomass, or seed yield are described in detail in Sun et al. (2017) Nature Communications, 8:14752; DOI: 10.1038/ncomms14752.

Example 41

This example describes the modification of four maize genes to provide increased nitrogen use efficiency, increased biomass and seed yield, hypersensitivity to ABA, and increased water use efficiency.

An increase in expression of NRT2.2, GLN1.4, Dof1, or an SPX domain-containing gene is predicted to increase nitrogen use efficiency.

An increase in expression of NRT2.2 (Zm00001d054060) is predicted to increase nitrogen use efficiency. A partial genomic sequence of NRT2.2 is provided as SEQ ID NO:381. A nitrogen responsive element sequence encoded by a polynucleotide (such as a double-stranded DNA, a single-stranded DNA, a single-stranded DNA/RNA hybrid, or a double-stranded DNA/RNA hybrid) is inserted upstream of the transcription start site (TSS) of the NRT2.2 coding region at a double-strand break effected between nucleotides at positions 101/102 of SEQ ID NO:381 in order to enhance the expression of NRT2.2. The nitrogen responsive element (AtNRE, see Examples 9, 13, and 16) is encoded by a 43 base-pair chemically modified dsDNA (Integrated DNA Technologies, Coralville, Iowa) having a first strand with the sequence of SEQ ID NO:349 annealed to a second strand with the sequence of SEQ ID NO:350;

each strand was phosphorylated on the 5' end and contained two phosphorothioate linkages at each terminus (i. e., the two linkages between the most distal three bases on either end of the strand). A NRT2.2 crRNA with the sequence of SEQ ID NO:397 is designed to target the nucleotides shown in bold italic in SEQ ID NO:381 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the NRT2.2 gene is carried out using procedures similar to those described in Examples 13-16. Similar genomic modification is carried out in maize germline cells using procedures as described in Examples 31-34; the resulting maize plants containing such a genomic modification are predicted to have increased nitrogen use efficiency.

An increase in expression of GLN1.4 (Zm00001d051804) is predicted to increase nitrogen use efficiency. A partial genomic sequence of GLN1.4 is provided as SEQ ID NO:382. A nitrogen responsive element sequence encoded by a polynucleotide (such as a double-stranded DNA, a single-stranded DNA, a single-stranded DNA/RNA hybrid, or a double-stranded DNA/RNA hybrid) donor molecule is inserted upstream of the transcription start site (TSS) of the GLN1.4 coding region at a double-strand break effected between nucleotides at positions 115/116 of SEQ ID NO:382 in order to enhance the expression of GLN1.4. The NRE is provided as a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i. e., the two linkages between the most distal three bases on either end of the strand). A GLN1.4 crRNA with the sequence of SEQ ID NO:398 is designed to target the nucleotide shown in bold italic in SEQ ID NO:382 (Table 16); the crRNA and tracrRNA are purchased from Integrated DNA Technologies, Coralville, Iowa. Ribonucleoprotein (RNP) complexes are prepared using gRNA (crRNA: tracrRNA) and Cas9 nuclease (Aldevron, Fargo, N. Dak.). Integration of the NRE sequence into the GLN1.4 gene is carried out using procedures similar to those described in Examples 13-16. Similar genomic modification is carried out in maize germline cells using procedures as described in Examples 31-34; the resulting maize plants containing such a genomic modification are predicted to have increased nitrogen use efficiency.

An increase in expression of Dof1 (Zm00001d031278) is predicted to increase nitrogen use efficiency. A partial genomic sequence of Dof1 is provided as SEQ ID NO:383. Constitutive overexpression of Dof1 has been shown to result in increased photosynthesis under low nitrate conditions in rice (DOI: 10.1111/j.1467-7652.2011.00592.x). In this embodiment the expression of Dof1 is modified to be constitutively expressed by inserting a constitutive enhancer sequence. A maize OCS homologue (see Examples 8 and 16) encoded by a chemically modified single-stranded DNA with the sequence of SEQ ID NO:343 (Integrated DNA Technologies, Coralville, Iowa), phosphorylated on the 5' end and containing two phosphorothioate linkages at each terminus (i. e., the two linkages between the most distal three bases on either end of the strand), is designed for insertion upstream of the transcription start site (TSS) of the Dof1 coding region at a double-strand break effected between nucleotides at positions 101/102 of SEQ ID NO:383 in order to enhance the expression of Dof1. A Dof1 crRNA with the sequence of SEQ ID NO:399 is designed to target the nucleotides shown in bold italic in SEQ ID NO:383 (Table 16); crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the maize OCS homologue sequence into the Dof1 gene is carried out using procedures similar to those described in Examples 13-16. Similar genomic modification is carried out in maize germline cells using procedures as described in Examples 31-34; the resulting maize plants containing such a genomic modification are predicted to have increased nitrogen use efficiency.

An increase in transcript stability of an SPX domain-containing gene simultaneously is predicted to increase nitrogen use efficiency. The maize SPX domain-containing gene selected for modification is GRMZM2G086430. A partial 5' untranslated region (5' UTR) sequence of this gene is provided as SEQ ID NO:998. The miRNA recognition site is located at nucleotide positions 267-287 of SEQ ID NO:998. Two crRNAs are designed to effect DSBs on either side of the miRNA recognition site, resulting in a 66 base-pair deletion in the genomic sequence; the first crRNA with the sequence of SEQ ID NO:1000 is designed to effect a DSB at 262 base-pairs downstream of (5' to) the transcription start site (TSS) and the second crRNA with the sequence of SEQ ID NO:1001 is designed to effect a DSB at 328 base-pairs downstream of (5' to) the TSS. The crRNAs and tracrRNA are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). The two RNPs are delivered together to the maize protoplasts using procedures similar to those described in Examples 13-16. The resulting partial sequence deletion in non-coding sequence of the SPX gene is expected to decouple the gene's expression from endogenous miRNA regulation, i. e., deregulating SPX expression in response to nitrate sufficient or phosphate sufficient conditions. Similar genomic modification is carried out in maize germline cells using procedures as described in Examples 31-34; the resulting maize plants containing such a genomic modification (decoupling of SPX expression from miRNA regulation) are predicted to have increased nitrogen use efficiency, especially under conditions of nitrogen deficiency.

An increase in expression of NRT2.2, GLN1.4, Dof1, or an SPX domain-containing gene and an increase in expression of PLA1 simultaneously is predicted to result in increased nitrogen use efficiency, increased leaf size, increased biomass, and increased seed yield. A partial genomic sequence of ZmPLA1 is provided as SEQ ID NO:1015. Three crRNAs targeting this region upstream of the ZmPLA1 TSS were designed effect double-strand breaks (DSBs) upstream or slightly downstream of the TSS; the first crRNA with the sequence of SEQ ID NO:1016 is designed to effect a DSB 150 base-pairs upstream of (5' to) the transcription start site (TSS), the second crRNA with the sequence of SEQ ID NO:1017 is designed to effect a DSB 95 base-pairs upstream of the TSS, and the third crRNA with the sequence of SEQ ID NO:1018 is designed to effect a DSB 19 base-pairs downstream of (3' to) the TSS. The sequence to be inserted at a DSB was a 2,046-bp promoter sequence of the maize GA2-oxidase with the sequence of SEQ ID NO:1019. Polynucleotide (such as a double-stranded DNA, a single-stranded DNA, a single-stranded DNA/RNA hybrid, or a double-stranded DNA/RNA hybrid) donor molecules are designed including the ZmGA2ox promoter (SEQ ID NO:1019) with the addition of homology arms (generally including about 50 to about 1000 nucleotides having sufficient sequence identity or complementarity to the genomic sequence flanking the site of the DSB) on one or on both sides of the promoter sequence to facilitate HDR-type integration of the donor sequence at the site of the DSB. The crRNAs, tracrRNA, and donor polynucleotides are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). Each individual RNP is delivered together with GA2ox promoter donor molecule to maize protoplasts using procedures similar to those described in Examples 13-16. Integration of the heterologous promoter is expected to result in localized upregulation of ZmPLA1 expression. Similar genomic modification is carried out in maize germline cells using procedures as described in Examples 31-34; the resulting maize plants containing such a genomic modification (operably linking the ZmGA2ox promoter to ZmPLA1) are predicted to have increased leaf area, increased biomass, and/or increased seed yield, compared to plants lacking the genomic modification. Growth chamber and field assays for measuring leaf area, biomass, or seed yield are described in detail in Sun et al. (2017) *Nature Communications,* 8:14752; DOI: 10.1038/ncomms14752.

An increase in expression of NRT2.2, GLN1.4, Dof1, or an SPX domain-containing gene, an increase in expression of PLA1, and a modified ABA hypersensitive PYL-E simultaneously is predicted to result in increased nitrogen use efficiency, increased leaf size, increased biomass, increased seed yield, and increased water use efficiency. The genomic sequence of ZmPYL-E provided as SEQ ID NO:1006 and a cDNA sequence is provided as SEQ ID NO:1007, which encodes the native amino acid sequence provided as SEQ ID NO:1008. In one approach, an ABA-hypersensitive ZmPLY-E allele is designed to have an amino acid change of E149L, i. e., glutamic acid (E) to leucine (L) at position 149 in the ZmPyl-E polypeptide. A non-limiting embodiment includes changing the codon encoding the amino acid at position 149 from GAG to CTG. A cDNA encoding the hypersensitive ZmPYL-E allele with the E149L mutation has the sequence of SEQ ID NO:1009. A single-guide RNA (sgRNA) including the sequence of SEQ ID NO:1010 is designed to effect a double-strand break (DSB) close to the nucleotides encoding the codon at position 149; the complete sgRNA sequence is provided as SEQ ID NO:1011, which includes a 33-nucleotide RNA extension to the 3' end of the sgRNA that acts as a tether to non-covalently link the Cas9/sgRNA complex by RNA:DNA duplex formation with a DNA donor molecule with homology arms that acts as an HDR template for editing the ZmPyl-E gene to effect the E149L amino acid change. This HDR template has the sequence of SEQ ID NO:1013 which includes a 33-nucleotide DNA extension, which is complementary to and will bind with the tether extension on the sgRNA. The HDR template encodes the E149L codon substitution and in addition encodes a mutation in the valine 152 codon which destroys the PAM site and prevents further cleavage by Cas9. The sgRNA and donor polynucleotides are purchased from Integrated DNA Technologies, Coralville, Iowa. Ribonucleoprotein (RNP) complexes are prepared using gRNA, HDR template and Cas9 nuclease (Aldevron, Fargo, N. Dak.). To assemble the complex, equal-molar amounts of sgRNA and polynucleotide donor molecule are mixed and heated to 95 degrees Celsius for 5 minutes, then removed from the heat and allowed to cool to room temperature. The appropriate amount of Cas9 is then added to sgRNA:donor complex and incubated at room temperature for 5 minutes. In embodiments, the Cas9:sgRNA:donor complex is delivered to maize cells by microinjection (e. g., into 1-3 days-after-pollination zygotes), electroporation (e. g., into 9-12 days-after-pollination zygotes), or bombardment or Biolistics (e. g., into 9-12 days-after-pollination zygotes). Biolistic delivery of RNPs to maize embryos is carried out using procedures similar to those described by Svitashev et al. (2016) *Nature Communications,* doi:10.1038/ncomms13274. The microinjection approach is described in Example 34. The electroporation approach is similar to techniques useful in wheat; see, e. g., T. Hagio (2009) "Direct Gene Transfer into Plant Mature Seeds via Electroporation After Vacuum Treatment." In: Electroporation and Sonoporation in Developmental Biology, edited by H. Nakamura, Springer, Japan, doi:10.1007/978-4-431-09427-2_25; and Klöt et al. (1993) *Plant Cell Reports,* 12:671-75, doi:10.1007/BF00233417. This method can be applied to excised 9-12 days-after-pollination embryos or partially germinated seed. Briefly, 20 seed are placed in germination buffer (0.2% polyvinylpyrrolidone (PVP), 0.001% active chlorine) in the dark at 10 degrees Celsius for 3 days. The seed are then transferred to electroporation buffer (0.25% polyvinylpyrrolidone (PVP), 0.15% Tween 20, 5 millimolar spermidine, 0.5% Cellulase (Onozuka RS), 0.125 molar calcium chloride dihydrate) containing the ZmPYL-E RNP complex described above. The mixture is placed under vacuum (0.9 Bar) for 3 hours at room temperature (22 degrees Celsius) for 3 hours. The seed are then placed in a 1-1.5 centimeter electroporation cuvette with the scutellum facing the positive electrode and submerged in electroporation buffer. An electronic pulse is delivered using a BTX Gemini X2 waveform generator (square waves, 75 volts, 50 millisecond pulse duration, 10 pulses/second, 100 pulses) one to three times. The seed are returned to germination medium and cultured in the dark at 26 degrees Celsius for 48 hours. Individual seed are then processed to evaluate the presence or absence of the intended edit.

An increase in expression of NRT2.2, GLN1.4, Dof1, or an SPX domain-containing gene, an increase in expression of PLA1, a modified ABA hypersensitive PYL-E, and an increase in expression of NAC111 simultaneously is predicted to result in increased nitrogen use efficiency, increased leaf size, increased biomass, increased seed yield, and further increased water use efficiency. The MITE insertion in the 5' untranslated region (5' UTR) of the maize NAC111 gene is modified in order to increase ZmNAC111 expression. The promoter sequence of NAC111 is provided as SEQ ID NO:1002, with the MITE sequence located at nucleotide positions 103-186 of SEQ ID NO:1002 (i. e., 414-498 base-pairs upstream of the NAC111 transcription start site).

In one approach, the MITE sequence is deleted or made non-functional by effecting at least one DSB in the MITE sequence. Two crRNAs are designed to effect DSBs on either side of the MITE sequence, resulting in deletion of the MITE sequence; the first crRNA with the sequence of SEQ ID NO:1003 is designed to effect a DSB 525 base-pairs upstream of the transcription start site (TSS) and the second crRNA with the sequence of SEQ ID NO:1004 is designed to effect a DSB at 396 base-pairs upstream of the TSS. The crRNAs and tracrRNA are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). The two RNPs are delivered together to the maize protoplasts using procedures similar to those described in Examples 13-16. The resulting partial sequence deletion in non-coding sequence of the ZmNAC111 gene is expected to result in upregulation of ZmNAC111 expression. Similar genomic modification is carried out in maize germline cells using procedures as described in Examples 31-34; the resulting maize plants containing such a genomic modification (deletion of the MITE sequence) are predicted to have increased water use efficiency (measured, e. g., by comparison of biomass or of seed yield of plants grown under different water availability regimes) and therefore enhanced drought tolerance.

In another approach, the MITE sequence is modified by targeted demethylation. Constructs encoding a modified dCas9-SunTag and an anti-GCN4 scFv fused to ten-eleven hydroxylase 1 (TET1), as described in detail by Morita et al. (2016) *Nature Biotechnol.*, 34:1060-1065; doi: 10.1038/nbt.3658), are used to demethylate the ZmNAC111 MITE region; these plasmids are publicly available from Addgene (see www[dot]addgene[dot]org/browse/article/22324/). Two crRNAs targeting the MITE region in the promoter of ZmNAC111 were designed to bring TET1 to MITE region and trigger demethylation; the first crRNA with the sequence of SEQ ID NO:1003 is designed to target 508-528 base-pairs upstream of the transcription start site (TSS) and the second crRNA with the sequence of SEQ ID NO:1005 is designed to target 425-445 base-pairs upstream of the TSS. The crRNAs and tracrRNA are purchased from Integrated DNA Technologies, Coralville, Iowa. Ribonucleoprotein (RNP) complexes are prepared using gRNA (crRNA:tracrRNA) complexes and Cas9 nuclease (Aldevron, Fargo, N. Dak.). The two RNPs are delivered together with the dCas9-SunTag and anti-GCN4 scFv/TET1 fusion plasmids to the maize protoplasts using procedures similar to those described in Examples 13-16. The resulting demethylation of the MITE region of the ZmNAC111 gene is expected to result in upregulation of ZmNAC111 expression. Similar genomic modification is carried out in maize germline cells using procedures as described in Examples 31-34; the resulting maize plants containing such a genomic modification (demethylation of the MITE sequence) are predicted to have increased water use efficiency (measured, e. g., by comparison of biomass or of seed yield of plants grown under different water availability regimes) and therefore enhanced drought tolerance.

Example 42

This example describes modification of different members in the same enzyme family or different family to maximize nitrogen use efficiency (NUE). Examples of genes and enzyme families are shown in Table 22. QPCR or RNA-Seq are used to evaluate NUE by investigating nitrate responsive gene expression level.

TABLE 22

| Enzyme family | Member | Gene ID | Change in gene activity | Element inserted | SEQ ID NO: |
|---|---|---|---|---|---|
| nitrate transporter (NRT) | ZmNRT1.1A | GRMZM2G086496 | Upregulate | AtNRE | SEQ ID NO: 1020 |
|  | ZmNRT1.1B | GRMZM2G161459 | Upregulate | AtNRE | SEQ ID NO: 1021 |
|  | ZmNRT1.1Ca | GMRZM2G112154 | Upregulate | AtNRE | SEQ ID NO: 1022 |
|  | ZmNRT1.1D | GMRZM2G161483 | Upregulate | AtNRE | SEQ ID NO: 1023 |
|  | ZmNRT1.2 | GRMZM2G137421 | Upregulate | AtNRE | SEQ ID NO: 1024 |
|  | ZmNRT1.3 | GMRZM2G176253 | Upregulate | AtNRE | SEQ ID NO: 1025 |
|  | ZmNRT1.4A | GMRZM2G064091 | Upregulate | AtNRE | SEQ ID NO: 1026 |
|  | ZmNRT1.4B | GMRZM2G476069 | Upregulate | AtNRE | SEQ ID NO: 1027 |
|  | ZmNRT1.5A | GRMZM2G044851 | Upregulate | AtNRE | SEQ ID NO: 1028 |
|  | ZmNRT1.5B | GMRZM2G061303 | Upregulate | AtNRE | SEQ ID NO: 1029 |
|  | ZmNRT2.1 | GRMZM2G010280 | Upregulate | AtNRE | SEQ ID NO: 1030 |
|  | ZmNRT2.2 | GRMZM2G010251 | Upregulate | AtNRE | SEQ ID NO: 1031 |
|  | ZmNRT2.3 | GRMZM2G163866 | Upregulate | AtNRE | SEQ ID NO: 1032 |
|  | ZmNRT2.5 | GRMZM2G455124 | Upregulate | AtNRE | SEQ ID NO: 1033 |
|  | ZmNRT3.1A | GRMZM2G179294 | Upregulate | AtNRE | SEQ ID NO: 1034 |
|  | ZmNRT3.1B | GMRZM2G163494 | Upregulate | AtNRE | SEQ ID NO: 1035 |
|  | ZmNRT3.2 | GMRZM2G808737 | Upregulate | AtNRE | SEQ ID NO: 1036 |
| Transcription factor | Dof1 | Zm00001d031278 | Upregulate | AtNRE | SEQ ID NO: 1037 |
| glutamine synthetase (GS) | ZmGln1.1 | P38559.1 | Upregulate | AtNRE | SEQ ID NO: 1038 |
|  | ZmGln1.2 | CAA46720.1 | Upregulate | AtNRE | SEQ ID NO: 1039 |
|  | ZmGln1.3 | CAA46721.1 | Upregulate | AtNRE | SEQ ID NO: 1040 |
|  | ZmGln1.4 | CAA46722.1 | Upregulate | AtNRE | SEQ ID NO: 1041 |
|  | ZmGln1.5 | P38563.2 | Upregulate | AtNRE | SEQ ID NO: 1042 |
|  | ZmGln2 | CAA46724.1 | Upregulate | AtNRE | SEQ ID NO: 1043 |
| glutamate synthase (GOGAT) | GOGAT1 | GRMZM2G077054 | Upregulate | AtNRE | SEQ ID NO: 1044 |
|  | GOGAT2 | GRMZM2G085078 | Upregulate | AtNRE | SEQ ID NO: 1045 |
|  | GOGAT3 | GRMZM2G375064 | Upregulate | AtNRE | SEQ ID NO: 1046 |
|  | FGS1 | GRMZM2G036609 | Upregulate | AtNRE | SEQ ID NO: 1047 |
| alanine aminotransferase (AlaAT) | AlaAT1 | Zm00001d003953 | Upregulate | AtNRE | SEQ ID NO: 1048 |
|  | AlaAT2 | Zm00001d030557 | Upregulate | AtNRE | SEQ ID NO: 1049 |
|  | AlaAT3 | Zm00001d008277 | Upregulate | AtNRE | SEQ ID NO: 1050 |
|  | AlaAT4 | Zm00001d006875 | Upregulate | AtNRE | SEQ ID NO: 1051 |
|  | AlaAT5 | Zm00001d032984 | Upregulate | AtNRE | SEQ ID NO: 1052 |
|  | AlaAT6 | Zm00001d020590 | Upregulate | AtNRE | SEQ ID NO: 1053 |
|  | AlaAT7 | Zm00001d022152 | Upregulate | AtNRE | SEQ ID NO: 1054 |
|  | AlaAT8 | Zm00001d044135 | Upregulate | AtNRE | SEQ ID NO: 1055 |
|  | AlaAT9 | Zm00001d014258 | Upregulate | AtNRE | SEQ ID NO: 1056 |
|  | AlaAT10 | Zm00001d018639 | Upregulate | AtNRE | SEQ ID NO: 1057 |

Maize protoplasts are prepared as described in Example 1. Preparation of reagents, gene editing procedures, and detection of gene modifications are carried out using procedures similar to those described in Examples 13-16.

An increase in expression of NRT2.2 (Zm00001d054060) is predicted to increase nitrogen use efficiency. A partial genomic sequence of NRT2.2 is provided as SEQ ID NO:381. A nitrogen responsive element sequence encoded by a polynucleotide (such as a double-stranded DNA, a single-stranded DNA, a single-stranded DNA/RNA hybrid, or a double-stranded DNA/RNA hybrid) is inserted upstream of the transcription start site (TSS) of the NRT2.2 coding region at a double-strand break effected between nucleotides at positions 101/102 of SEQ ID NO:381 in order to enhance the expression of NRT2.2. The nitrogen responsive element (AtNRE, see Examples 9, 13, and 16) is encoded by a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i. e., the two linkages between the most distal three bases on either end of the strand). A NRT2.2 crRNA with the sequence of SEQ ID NO:397 is designed to target the nucleotides shown in bold italic in SEQ ID NO:381 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the NRT2.2 gene is carried out using procedures similar to those described in Examples 13-16. Similar genomic modification is carried out in maize germline cells using procedures as described in Examples 31-34; the resulting maize plants containing such a genomic modification are predicted to have increased nitrogen use efficiency.

An increase in expression of NRT2.2 and GLN1.4 (Zm00001d051804) simultaneously is predicted to further increase nitrogen use efficiency. A partial genomic sequence of GLN1.4 is provided as SEQ ID NO:382. A nitrogen responsive element sequence encoded by a polynucleotide (such as a double-stranded DNA, a single-stranded DNA, a single-stranded DNA/RNA hybrid, or a double-stranded DNA/RNA hybrid) donor molecule is inserted upstream of the transcription start site (TSS) of the GLN1.4 coding region at a double-strand break effected between nucleotides at positions 115/116 of SEQ ID NO:382 in order to enhance the expression of GLN1.4. The NRE is provided as a 43 base-pair chemically modified dsDNA (Integrated DNA Technologies, Coralville, Iowa) having a first strand with the sequence of SEQ ID NO:349 annealed to a second strand with the sequence of SEQ ID NO:350; each strand was phosphorylated on the 5' end and contained two phosphorothioate linkages at each terminus (i. e., the two linkages between the most distal three bases on either end of the strand). A GLN1.4 crRNA with the sequence of SEQ ID NO:398 is designed to target the nucleotide shown in bold italic in SEQ ID NO:382 (Table 16); the crRNA and tracrRNA are purchased from Integrated DNA Technologies, Coralville, Iowa. Ribonucleoprotein (RNP) complexes are prepared using gRNA (crRNA:tracrRNA) and Cas9 nuclease (Aldevron, Fargo, N. Dak.). Integration of the NRE sequence into the GLN1.4 gene is carried out using procedures similar to those described in Examples 13-16. Similar genomic modification is carried out in maize germline cells using procedures as described in Examples 31-34; the resulting maize plants containing such a genomic modification are predicted to have increased nitrogen use efficiency.

An increase in expression of NRT2.2, GLN1.4, and Dof1 (Zm00001d031278) simultaneously is predicted to even further increase nitrogen use efficiency. A partial genomic sequence of Dof1 is provided as SEQ ID NO:383. Constitutive overexpression of Dof1 has been shown to result in increased photosynthesis under low nitrate conditions in rice (DOI: 10.1111/j.1467-7652.2011.00592.x). In this embodiment the expression of Dof1 is modified to be constitutively expressed by inserting a constitutive enhancer sequence. A maize OCS homologue (see Examples 8 and 16) encoded by a chemically modified single-stranded DNA with the sequence of SEQ ID NO:343 (Integrated DNA Technologies, Coralville, Iowa), phosphorylated on the 5' end and containing two phosphorothioate linkages at each terminus (i. e., the two linkages between the most distal three bases on either end of the strand), is designed for insertion upstream of the transcription start site (TSS) of the Dof1 coding region at a double-strand break effected between nucleotides at positions 101/102 of SEQ ID NO:383 in order to enhance the expression of Dof1. A Dof1 crRNA with the sequence of SEQ ID NO:399 is designed to target the nucleotides shown in bold italic in SEQ ID NO:383 (Table 16); crRNA and tracrRNA are purchased from Integrated DNA Technologies, Coralville, Iowa. Ribonucleoprotein (RNP) complexes are prepared using gRNA (crRNA: tracrRNA) and Cas9 nuclease (Aldevron, Fargo, N. Dak.). Integration of the maize OCS homologue sequence into the Dof1 gene is carried out using procedures similar to those described in Examples 13-16. Similar genomic modification is carried out in maize germline cells using procedures as described in Examples 31-34; the resulting maize plants containing such a genomic modification are predicted to have increased nitrogen use efficiency.

Example 43

Table 23 provides a list of genes in corn associated with various traits including abiotic stress resistance, plant architecture, biotic stress resistance, photosynthesis, and resource partitioning. Within each trait, various non-limiting (and often overlapping) sub-categories of traits may be identified, as presented in the Table. For example, "abiotic stress resistance" may be related to or associated with changes in abscisic acid (ABA) signaling, biomass, cold tolerance, drought tolerance, tolerance to high temperatures, tolerance to low temperatures, and/or salt tolerance; the trait "plant architecture" may be related to or may include traits such as biomass, fertilization, flowering time and/or flower architecture, inflorescence architecture, lodging resistance, root architecture, shoot architecture, leaf architecture, and yield; the trait "biotic stress" may include disease resistance, insect resistance, population density stress and/or shading stress; the trait "photosynthesis" can include photosynthesis and respiration traits; the trait "resource partitioning" can include or be related to biomass, seed weight, drydown rate, grain size, nitrogen utilization, oil production and metabolism, protein production and metabolism, provitamin A production and metabolism, seed composition, seed filling (including sugar and nitrogen transport), and starch production and metabolism. By modifying one or more of the associated genes in Table 23, each of these traits may be manipulated singly or in combination to improve the yield, productivity or other desired aspects of a corn plant comprising the modification(s).

Each of the genes listed in Table 23 may be modified using any of the gene modification methods described herein. In particular, each of the genes may be modified using the targeted modification methods described herein which introduce desired genomic changes at specific locations in the absence of off-target effects. Even more specifically, each of the genes in Table 23 may be modified using the CRISPR targeting methods described herein, either singly or in multiplexed fashion. For example, a single gene in Table 23 could be modified by the introduction of a single mutation (change in residue, insertion of residue(s), or deletion of residue(s)) or by multiple mutations. Another possibility is that a single gene in Table 23 could be modified by the introduction of two or more mutations, including two or more targeted mutations. In addition, or alternatively, two or more genes in Table 23 could be modified (e.g., using the targeted modification techniques described herein) such that the two or more genes each contains one or more modifications.

The various types of modifications that can be introduced into the genes of Table 23 have been described herein. The modifications include both modifications to regulatory regions that affect the expression of the gene product (i.e., the amount of proteins or RNA encoded by the gene) and modifications that affect the sequence or activity of the encoded protein or RNA (in some cases the same modification may affect both the expression level and the activity of the encoded protein or RNA). Modifying genes encoding proteins with the amino acid sequences listed in Table 23 (the even numbered SEQ IDs 434-562, 566, 568, and 572-762), or sequences with at least 95%, 96%, 97%, 98%, or 99% identity to the protein sequences listed in Table 23, may result in proteins with improved or diminished activity. Methods of alignment of sequences for comparison are well known in the art. Two examples of algorithms that are suitable for determining percent sequence identity and sequence similarity are the BLAST® and BLAST® 2.0 algorithms, which are described in Altschul et al., (1977) Nuc. Acids Res. 25:3389-3402; and Altschul et al., (1990) J. Mol. Biol. 215:403-410, respectively. Software for performing BLAST® analyses is publicly available through the National Center for Biotechnology Information. Optimal alignment of sequences for comparison can also be conducted, e.g., by the local homology algorithm of Smith and Waterman, (1970) Adv. Appl. Math. 2:482c, by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) Current Protocols in Molecular Biology).

In some cases, targeted modifications may result in proteins with no activity (e.g., the introduction of a stop codon may result in a functionless protein) or a protein with a new activity or feature. Similarly, the sequences of the miRNAs listed in Table 23 (SEQ IDs 563 and 569) may also be modified to increase, decrease or reduce their activity.

In addition to modifications to the encoded proteins or miRNAs, each of the gene sequences listed in Table 23 (the odd numbered SEQ IDs 433-761) may also be modified, individually or in combination with one or more other modifications, to alter the expression of the encoded protein or RNA, or to alter the stability of the RNA encoding the protein. For example, regulatory sequences affecting transcription of any of the genes listed in Table 23, including primer sequences and transcription factor binding sequences, can be modified, or introduced into, any of the gene sequences listed in Table 23 using the methods describes herein. The modifications can effect increases in transcription levels, decreases in transcription levels, and/or changes in the timing of transcription of the genes under control of the modified regulatory regions. Targeted epigenetic modifications affecting gene expression may also be introduced.

One skilled in the art will be able to identify regulatory regions (e.g., regulatory regions in the gene sequences provided in Table 23) using techniques described in the literature, e.g., Bartlett A. et al, "Mapping genome-wide transcription-factor binding sites using DAP-seq.", Nat Protoc. (2017) August; 12(8):1659-1672; O'Malley R. C. et al, "Cistrome and Epicistrome Features Shape the Regulatory DNA Landscape", Cell (2016) September 8; 166(6):1598; He Y et al, "Improved regulatory element prediction based on tissue-specific local epigenomic signatures", Proc Natl Acad Sci USA, (2017) February 28; 114(9):E1633-E1640; Zefu Lu et al, "Combining ATAC-seq with nuclei sorting for discovery of cis-regulatory regions in plant genomes", Nucleic Acids Research, (2017) V45(6); Rurika Oka et al, "Genome-wide mapping of transcriptional enhancer candidates using DNA and chromatin features in maize", Genome Biology (2017) 18:137. In addition, Table 24, provided herein, lists sequences which may be inserted into or otherwise created in the genomic sequences of Table 23 for the purpose of regulating gene expression and/or transcript stability.

The stability of transcribed RNA encoded by the genes in Table 23 (in addition to other genes), can be increased or decreased by the targeted insertion or creation of the transcript stabilizing or destabilizing sequences provided in Table 24 (e.g., SEQ ID Nos. 942-944).

Any of the above regulatory modifications may be combined to regulate a single gene, or multiple genes, or they may be combined with the non-regulatory modifications discussed above to regulate the activity of a single modified gene, or multiple modified genes. The genetic modifications or gene regulatory changes discussed above may affect distinct traits in the corn cell or plant, or they make affect the same trait. The resulting effects of the described modifications on a trait or trait may be additive or synergistic. Modifications to the corn genes listed in Table 24 may be combined with modifications to other sequences in the corn genome for the purpose of improving one or more corn traits. The corn sequences of Table 24 may also be modified for the purpose of tracking the expression or localizing the expression or activity of the listed genes and gene products.

TABLE 23

| Trait | Trait subcategory | Gene(s) | GeneID | GeneProduct | Expression Change | Gene SEQ ID | Protein SEQ ID |
|---|---|---|---|---|---|---|---|
| Abiotic stress | ABA Signaling | ZmbZIP17 | 100284034 | protein | Increase | SEQ ID NO: 433 | SEQ ID NO: 434 |
| Abiotic stress | Biomass | TsVP | 542328 | protein | Increase | SEQ ID NO: 435 | SEQ ID NO: 436 |
| Abiotic stress | Cold tolerance | ZmSEC14p | 100274321 | protein | Increase | SEQ ID NO: 437 | SEQ ID NO: 438 |
| Abiotic stress | Drought tolerance | ZmPLC1 | 542162 | protein | Increase | SEQ ID NO: 439 | SEQ ID NO: 440 |

TABLE 23-continued

| Trait | Trait subcategory | Gene(s) | GeneID | GeneProduct | Expression Change | Gene SEQ ID | Protein SEQ ID |
|---|---|---|---|---|---|---|---|
| Abiotic stress | Drought tolerance | ZmNF-YB | 542390 | protein | Increase | SEQ ID NO: 441 | SEQ ID NO: 442 |
| Abiotic stress | Drought tolerance | D-myo-inositol-3-phosphate synthase (IPS) | 542540 | protein | Increase | SEQ ID NO: 443 | SEQ ID NO: 444 |
| Abiotic stress | Drought tolerance | ZmPIS | 542548 | protein | Increase | SEQ ID NO: 445 | SEQ ID NO: 446 |
| Abiotic stress | Drought tolerance | ZmGOLS2 | 606405 | protein | Increase | SEQ ID NO: 447 | SEQ ID NO: 448 |
| Abiotic stress | Drought tolerance | ZmPsbA | 845199 | protein | Increase | SEQ ID NO: 449 | SEQ ID NO: 450 |
| Abiotic stress | Drought tolerance | ZmSNAC1 | 100170665 | protein | Increase | SEQ ID NO: 451 | SEQ ID NO: 452 |
| Abiotic stress | Drought tolerance | ZmbZIP72 | 100191233 | protein | Increase | SEQ ID NO: 453 | SEQ ID NO: 454 |
| Abiotic stress | Drought tolerance | Zmhdz10 | 100194336 | protein | Increase | SEQ ID NO: 455 | SEQ ID NO: 456 |
| Abiotic stress | Drought tolerance | GB1 | 100217119 | protein | Increase | SEQ ID NO: 457 | SEQ ID NO: 458 |
| Abiotic stress | Drought tolerance | ACC synthase | 100217270 | protein | Decrease | SEQ ID NO: 459 | SEQ ID NO: 460 |
| Abiotic stress | Drought tolerance | ZmARGOS8 | 100275015 | protein | Increase | SEQ ID NO: 461 | SEQ ID NO: 462 |
| Abiotic stress | Drought tolerance | ZmPIF3 | 100279991 | protein | Increase | SEQ ID NO: 463 | SEQ ID NO: 464 |
| Abiotic stress | Drought tolerance | ZmNAC111 | 100502408 | protein | Increase | SEQ ID NO: 465 | SEQ ID NO: 466 |
| Abiotic stress | Drought tolerance | ZmRFP1 | 100280655 | protein | Increase | SEQ ID NO: 467 | SEQ ID NO: 468 |
| Abiotic stress | Drought tolerance | ZmPP2C-A | 732729 | protein | Increase | SEQ ID NO: 469 | SEQ ID NO: 470 |
| Abiotic stress | Drought tolerance | ZmABP9 | 100502540 | protein | Increase | SEQ ID NO: 471 | SEQ ID NO: 472 |
| Abiotic stress | Drought tolerance | ZmJAZ14 | 103626248 | protein | Increase | SEQ ID NO: 473 | SEQ ID NO: 474 |
| Abiotic stress | Drought tolerance | ZmNAC55 | 103643272 | protein | Increase | SEQ ID NO: 475 | SEQ ID NO: 476 |
| Abiotic stress | Drought tolerance | ABAZmPYL-3 | 100273694 | protein | AA change | SEQ ID NO: 477 | SEQ ID NO: 478 |
| Abiotic stress | flooding tolerance | HB2 | 732720 | protein | Increase | SEQ ID NO: 479 | SEQ ID NO: 480 |
| Abiotic stress | High temperature and salt tolerance | ZmAPT2 | 542148 | protein | Increase | SEQ ID NO: 481 | SEQ ID NO: 482 |
| Abiotic stress | low temperature stress | ZmLEA3 | 100283639 | protein | Increase | SEQ ID NO: 483 | SEQ ID NO: 484 |
| Abiotic stress | Low temperature tolerance | ZmPP2C2 | 542176 | protein | Increase | SEQ ID NO: 485 | SEQ ID NO: 486 |
| Abiotic stress | Salt tolerance | ZmSAPK8 | 100283283 | protein | Increase | SEQ ID NO: 487 | SEQ ID NO: 488 |
| Abiotic stress | Salt tolerance | ZmCIPK16 | 100285849 | protein | Increase | SEQ ID NO: 489 | SEQ ID NO: 490 |
| Abiotic stress | Salt tolerance | ZmPEAMT | 103651303 | protein | Increase | SEQ ID NO: 491 | SEQ ID NO: 492 |
| Abiotic stress | Stress response | ZmPHR1 | 100382084 | protein | Increase | SEQ ID NO: 493 | SEQ ID NO: 494 |
| Architecture | fertilization | Barren stalk 1 (Zmba1) | 542186 | protein | Increase | SEQ ID NO: 497 | SEQ ID NO: 498 |
| Architecture | fertilization | Barren inflorescence4(Bif4) | 100284398 | protein | Increase | SEQ ID NO: 499 | SEQ ID NO: 500 |
| Architecture | Flowering time/architecture | Indeterminate1 (ID1) | 541693 | protein | Increase/Decrease | SEQ ID NO: 501 | SEQ ID NO: 502 |
| Architecture | Flowering time/architecture | ZMM4 | 542041 | protein | Increase/Decrease | SEQ ID NO: 503 | SEQ ID NO: 503 |
| Architecture | Flowering time/architecture | supressor of overexpression of constans1 (SOC1) | 542042 | protein | Increase/Decrease | SEQ ID NO: 505 | SEQ ID NO: 506 |
| Architecture | Flowering time/architecture | Zfl1 (LEAFY homolog) | 542098 | protein | Increase/Decrease | SEQ ID NO: 507 | SEQ ID NO: 508 |
| Architecture | Flowering time/architecture | Zag1 (agamous) | 542244 | protein | Increase/Decrease | SEQ ID NO: 509 | SEQ ID NO: 510 |
| Architecture | Flowering time/architecture | Zag2 (Agamous) | 542325 | protein | Increase/Decrease | SEQ ID NO: 511 | SEQ ID NO: 512 |
| Architecture | Flowering time/architecture | DLF1(Delayed flowering 1) | 100037791 | protein | Increase/Decrease | SEQ ID NO: 513 | SEQ ID NO: 514 |
| Architecture | Flowering time/architecture | ZCN7 | 100127518 | protein | Increase/Decrease | SEQ ID NO: 515 | SEQ ID NO: 516 |
| Architecture | Flowering time/architecture | ZCN8 (Zia Mays Centroradiales8) | 100127519 | protein | Increase/Decrease | SEQ ID NO: 517 | SEQ ID NO: 518 |
| Architecture | Flowering time/architecture | RAP2.7 | 103635944 | protein | Increase/Decrease | SEQ ID NO: 519 | SEQ ID NO: 520 |
| Architecture | Flowering time/architecture | Zfl2 (LEAFY homolog) | 103645994 | protein | Increase/Decrease | SEQ ID NO: 521 | SEQ ID NO: 522 |
| Architecture | Growth | ZmPTR1 | 100280282 | protein | Increase | SEQ ID NO: 523 | SEQ ID NO: 524 |
| Architecture | Inflorescence architecture | Zmra3 | 732774 | protein | Increase/Decrease | SEQ ID NO: 525 | SEQ ID NO: 526 |
| Architecture | Inflorescence architecture | Zmra2 | 100193308 | protein | Increase | SEQ ID NO: 527 | SEQ ID NO: 528 |
| Architecture | Lodging resistance | BrittleStalk2 | 778435 | protein | Increase | SEQ ID NO: 529 | SEQ ID NO: 530 |
| Architecture | Lodging resistance | Caffeic acid 3-0-methyltransferase | 100125646 | protein | Increase | SEQ ID NO: 531 | SEQ ID NO: 532 |
| Architecture | Lodging resistance | Strongculm2b | 103629662 | protein | Increase | SEQ ID NO: 533 | SEQ ID NO: 534 |
| Architecture | Lodging resistance | Strongculm2a | 103638875 | protein | Increase | SEQ ID NO: 535 | SEQ ID NO: 536 |
| Architecture | other | Cenh3 | 542500 | protein | AA change | SEQ ID NO: 537 | SEQ ID NO: 538 |
| Architecture | Root architecture | ZmPP2AA1 | 732740 | protein | Increase | SEQ ID NO: 539 | SEQ ID NO: 540 |
| Architecture | Root Architecture | rootless1 | 100101548 | protein | Increase | SEQ ID NO: 541 | SEQ ID NO: 542 |
| Architecture | Root Architecture | Rul1 (Rum 1 like) | 100193994 | protein | Increase/Decrease | SEQ ID NO: 543 | SEQ ID NO: 544 |
| Architecture | Root Architecture | Brevis Radix(BRX) | 100501926 | protein | Increase | SEQ ID NO: 545 | SEQ ID NO: 546 |
| Architecture | Root Architecture | rth1 (root hair) | 100502100 | protein | Increase | SEQ ID NO: 547 | SEQ ID NO: 548 |
| Architecture | Root Architecture | Wox11 | 103633577 | protein | Increase | SEQ ID NO: 549 | SEQ ID NO: 550 |

TABLE 23-continued

| Trait | Trait subcategory | Gene(s) | GeneID | GeneProduct | Expression Change | Gene SEQ ID | Protein SEQ ID |
|---|---|---|---|---|---|---|---|
| Architecture | RootArchitecture | RTCL(RTCSlike) | 100101549 | protein | Increase | SEQ ID NO: 551 | SEQ ID NO: 552 |
| Architecture | shoot Architecture | tb1 | 103643875 | protein | Increase/Decrease | SEQ ID NO: 553 | SEQ ID NO: 554 |
| Architecture | shoot Architecture | knotted1 (KN1) | 542391 | protein | Increase | SEQ ID NO: 555 | SEQ ID NO: 556 |
| Architecture | shoot Architecture | tasselsheath4 (tsh4) | 542666 | protein | Increase | SEQ ID NO: 557 | SEQ ID NO: 558 |
| Architecture | shoot Architecture | fea2 | 542675 | protein | Decrease | SEQ ID NO: 559 | SEQ ID NO: 560 |
| Architecture | Shoot Architecture | Ga20ox | 778427 | protein | Increase/Decrease | SEQ ID NO: 561 | SEQ ID NO: 562 |
| Architecture | shoot Architecture | MIR156 | 100126884 | microRNA | Increase | SEQ ID NO: 563 | |
| Architecture | shoot Architecture | unbranched 2(ub2) | 541996 | protein | Increase/Decrease | SEQ ID NO: 565 | SEQ ID NO: 566 |
| Architecture | Shoot architecture | RAMOSA1 | 100276104 | protein | Increase | SEQ ID NO: 567 | SEQ ID NO: 568 |
| Architecture | Shoot architecture | miRNA172 | 100278541 | microRNA | Increase/Decrease | SEQ ID NO: 569 | |
| Architecture | Shoot Architecture | drooping leaf (drl1) | 100282346 | protein | Increase/Decrease | SEQ ID NO: 571 | SEQ ID NO: 572 |
| Architecture | shoot Architecture | compact plant2 (ct2) | 100284718 | protein | Decrease | SEQ ID NO: 573 | SEQ ID NO: 574 |
| Architecture | Shoot Architecture | brachytic (br2)(pgp1) | 100384057 | protein | Increase/Decrease | SEQ ID NO: 575 | SEQ ID NO: 576 |
| Architecture | Shoot Architecture | drooping leaf (drl2) | 100502185 | protein | Increase/Decrease | SEQ ID NO: 577 | SEQ ID NO: 578 |
| Architecture | Shoot Architecture | thick tassel dwarf1 (tdl) | 103626458 | protein | Decrease | SEQ ID NO: 579 | SEQ ID NO: 580 |
| Architecture | Shoot Architecture | PLASTOCHRON1 (PLA1) | 100126887 | protein | Increase | SEQ ID NO: 581 | SEQ ID NO: 582 |
| Architecture | Shoot Architecture | FON2-likeCLE protein 1 (ZmFCP1) | 103646325 | protein | Increase/Decrease | SEQ ID NO: 583 | SEQ ID NO: 584 |
| Architecture | Shoot Architecture | tga1 | 103653213 | protein | Decrease | SEQ ID NO: 585 | SEQ ID NO: 586 |
| Architecture | shoot Architecture | unbranched 3 (ub3) | 103654498 | protein | Decrease | SEQ ID NO: 587 | SEQ ID NO: 588 |
| Architecture | Shoot Architecture | fasciated ear 4 (fea4, PERIANTHIA homolog) | 107403067 | protein | Decrease | SEQ ID NO: 589 | SEQ ID NO: 590 |
| Architecture | Shoot Architecture (meristem) | WUS2 (wuschel2) | 100037787 | protein | Increase | SEQ ID NO: 591 | SEQ ID NO: 592 |
| Architecture | Shoot Architecture (meristem) | BBM (babyboom) | 100281144 | protein | Increase | SEQ ID NO: 593 | SEQ ID NO: 594 |
| Architecture | shootArchitecture | fea3 | 100216564 | protein | Decrease | SEQ ID NO: 595 | SEQ ID NO: 596 |
| Architecture | Yield | ZmARGOS1 | 100274970 | protein | Increase | SEQ ID NO: 597 | SEQ ID NO: 598 |
| Architecture | Yield | ZmCNRl | 100284956 | protein | Decrease | SEQ ID NO: 599 | SEQ ID NO: 600 |
| Biotic Stress | Disease Resistance | GST23 | 541845 | protein | AA change | SEQ ID NO: 601 | SEQ ID NO: 602 |
| Biotic Stress | Disease Resistance | ZmAE3 | 541993 | protein | Increase | SEQ ID NO: 603 | SEQ ID NO: 604 |
| Biotic Stress | Disease Resistance | Zm ERF1 | 542184 | protein | Increase | SEQ ID NO: 605 | SEQ ID NO: 606 |
| Biotic Stress | Disease Resistance | Zm LOX3 | 103635903 | protein | Increase | SEQ ID NO: 607 | SEQ ID NO: 608 |
| Biotic Stress | Disease Resistance | ZmEsr6 | 606439 | protein | Increase | SEQ ID NO: 609 | SEQ ID NO: 610 |
| Biotic Stress | Disease Resistance | Zm Trxh | 606450 | protein | Increase + AA change | SEQ ID NO: 611 | SEQ ID NO: 612 |
| Biotic Stress | Disease Resistance | Hm1 | 732845 | protein | Increase | SEQ ID NO: 613 | SEQ ID NO: 614 |
| Biotic Stress | Disease Resistance | ZmWRKY53 | 100147737 | protein | Increase | SEQ ID NO: 615 | SEQ ID NO: 616 |
| Biotic Stress | Disease Resistance | PRms | 100272820 | protein | Increase | SEQ ID NO: 617 | SEQ ID NO: 618 |
| Biotic Stress | Disease Resistance | Zm PR1 | 100273383 | protein | Increase | SEQ ID NO: 619 | SEQ ID NO: 620 |
| Biotic Stress | Disease Resistance | RP1-D | 100274731 | protein | Increase | SEQ ID NO: 621 | SEQ ID NO: 622 |
| Biotic Stress | Disease Resistance | Zmpep1 from gene Zm PROPEP1 | 103645871 | protein | Increase | SEQ ID NO: 623 | SEQ ID NO: 624 |
| Biotic Stress | Disease Resistance | Remorin Zm REM6.3 | 100277367 | protein | Increase | SEQ ID NO: 625 | SEQ ID NO: 626 |
| Biotic Stress | Disease Resistance | Zm NPR1 | 100281196 | protein | Increase | SEQ ID NO: 627 | SEQ ID NO: 628 |
| Biotic Stress | Disease Resistance | ZmWRKY67 | 100285526 | protein | Increase | SEQ ID NO: 629 | SEQ ID NO: 630 |
| Biotic Stress | Disease Resistance | ZmWAK | 100304375 | protein | Increase | SEQ ID NO: 631 | SEQ ID NO: 632 |
| Biotic Stress | Disease Resistance | Pan1 | 100501323 | protein | Increase | SEQ ID NO: 633 | SEQ ID NO: 634 |
| Biotic Stress | Disease Resistance | Rxo1 (PIC 19 paralog 1) | 103629015 | protein | Increase | SEQ ID NO: 635 | SEQ ID NO: 636 |
| Biotic Stress | Disease Resistance | ZmWAK-RLK1 (Htn1) | 103636194 | protein | AA change | SEQ ID NO: 637 | SEQ ID NO: 638 |
| Biotic Stress | Disease Resistance | ZmWRKY19 | 103651065 | protein | Increase | SEQ ID NO: 639 | SEQ ID NO: 640 |
| Biotic Stress | Disease Resistance | Rcg1 | — | protein | Increase | | SEQ ID NO: 642 |
| Biotic Stress | Insect resistance | ZmP1 | 542272 | protein | Increase | SEQ ID NO: 643 | SEQ ID NO: 644 |
| Biotic Stress | insect Resistance | mpi | 542408 | protein | Increase | SEQ ID NO: 645 | SEQ ID NO: 646 |
| Biotic Stress | insect Resistance | proteinase, mir1 | 542561 | protein | Increase | SEQ ID NO: 647 | SEQ ID NO: 648 |
| Biotic Stress | Population density/stress/shading | COP1 | 100286122 | protein | Increase | SEQ ID NO: 649 | SEQ ID NO: 650 |
| Biotic Stress | Population density/stress/shading | PhyB2 | 100381811 | protein | Decrease | SEQ ID NO: 651 | SEQ ID NO: 652 |
| Biotic Stress | Population density/stress/shading | PhyB1 | 100383702 | protein | Decrease | SEQ ID NO: 653 | SEQ ID NO: 654 |
| Photosynthesis | photosynthesis | PsbS | 542126 | protein | Increase | SEQ ID NO: 655 | SEQ ID NO: 656 |
| Photosynthesis | photosynthesis | ZEP | 100280949 | protein | Increase | SEQ ID NO: 657 | SEQ ID NO: 658 |

TABLE 23-continued

| Trait | Trait subcategory | Gene(s) | GeneID | GeneProduct | Expression Change | Gene SEQ ID | Protein SEQ ID |
|---|---|---|---|---|---|---|---|
| Photosynthesis | photosynthesis | VDE | 100281366 | protein | Increase | SEQ ID NO: 659 | SEQ ID NO: 660 |
| Photosynthesis | photosynthesis | sedoheptulose-1,7-bisphosphatase(SBPase) | 100282017 | protein | Increase | SEQ ID NO: 661 | SEQ ID NO: 662 |
| Photosynthesis | photosynthesis | Fbpase; fructose-1,6-bisphosphatase | 100284739 | protein | Increase | SEQ ID NO: 663 | SEQ ID NO: 664 |
| Photosynthesis | Respiration | Alternative oxidase AOX | 542074 | protein | Decrease | SEQ ID NO: 665 | SEQ ID NO: 666 |
| Resource Partitioning | Biomass | ZmDof1 | 100283759 | protein | Increase | SEQ ID NO: 667 | SEQ ID NO: 668 |
| Resource Partitioning | Biomass | OsPSTOL1 | 103653161 | protein | Increase | SEQ ID NO: 669 | SEQ ID NO: 670 |
| Resource Partitioning | Biomass (seed weight) | AlaAT | 100282849 | protein | Increase | SEQ ID NO: 671 | SEQ ID NO: 672 |
| Resource Partitioning | Biomass (stress response) | ZmNRT2.2 | 606442 | protein | Increase | SEQ ID NO: 673 | SEQ ID NO: 674 |
| Resource Partitioning | Drydown rate | esp5 | 542280 | protein | Decrease | SEQ ID NO: 675 | SEQ ID NO: 676 |
| Resource Partitioning | Drydown rate | esp1 | 542384 | protein | Decrease | SEQ ID NO: 677 | SEQ ID NO: 678 |
| Resource Partitioning | GrainSize | ZmGW2-CHR5 | 100276421 | protein | Increase/Decrease | SEQ ID NO: 679 | SEQ ID NO: 680 |
| Resource Partitioning | GrainSize | ZmGW2-CHR4 | 100277474 | protein | Increase/Decrease | SEQ ID NO: 681 | SEQ ID NO: 682 |
| Resource Partitioning | Nitrogen | Gln1-3 (Gln1.3) | 542214 | protein | Increase | SEQ ID NO: 683 | SEQ ID NO: 684 |
| Resource Partitioning | Nitrogen | Gln1-4 (Gln1.4) | 542401 | protein | Increase | SEQ ID NO: 685 | SEQ ID NO: 686 |
| Resource Partitioning | Nitrogen | Asn synthetase | 542435 | protein | Increase | SEQ ID NO: 687 | SEQ ID NO: 688 |
| Resource Partitioning | Nitrogen | OsENOD93-1 | 100193182 | protein | Increase | SEQ ID NO: 689 | SEQ ID NO: 690 |
| Resource Partitioning | Nitrogen | Asp AT | 100273311 | protein | Increase | SEQ ID NO: 691 | SEQ ID NO: 692 |
| Resource Partitioning | Nitrogen | NAD(H)-dependent GOGAT 1 | 103636185 | protein | Increase | SEQ ID NO: 693 | SEQ ID NO: 694 |
| Resource Partitioning | Nitrogen | [SPX gene] | 100193704 | | | SEQ ID NO: 695 | SEQ ID NO: 696 |
| Resource Partitioning | Oil | DGAT1 | 103629820 | protein | AA change | SEQ ID NO: 697 | SEQ ID NO: 698 |
| Resource Partitioning | Oil body accumulation | obap1 | 100193701 | protein | Increase | SEQ ID NO: 699 | SEQ ID NO: 700 |
| Resource Partitioning | Protein | pbf1 | 542353 | protein | Increase | SEQ ID NO: 701 | SEQ ID NO: 702 |
| Resource Partitioning | Protein | O2 | 542375 | protein | Decrease | SEQ ID NO: 703 | SEQ ID NO: 704 |
| Resource Partitioning | Protein | ZmAAP4 (amino acid permease 4) | 100274520 | protein | Increase | SEQ ID NO: 705 | SEQ ID NO: 706 |
| Resource Partitioning | Protein | ZmVAAT3 (Vacuolar amino acid transporter) | 100383728 | protein | Increase | SEQ ID NO: 707 | SEQ ID NO: 708 |
| Resource Partitioning | provitamin A | crtRB1 | 732825 | protein | Decrease | SEQ ID NO: 709 | SEQ ID NO: 710 |
| Resource Partitioning | Seed composition | ZmMRP1 | 103635903 | protein | Increase | SEQ ID NO: 711 | SEQ ID NO: 712 |
| Resource Partitioning | Seed composition | SWEET4c | 100273706 | protein | Increase | SEQ ID NO: 713 | SEQ ID NO: 714 |
| Resource Partitioning | seed filling - sugar nitrogen transport | ZmDA1 | 100191921 | protein | Decrease or AA change | SEQ ID NO: 715 | SEQ ID NO: 716 |
| Resource Partitioning | seed filling - sugar nitrogen transport | ZmDAR1 | 100501585 | protein | Decrease or AA change | SEQ ID NO: 717 | SEQ ID NO: 718 |
| Resource Partitioning | starch | dull1 | 541657 | protein | Increase | SEQ ID NO: 719 | SEQ ID NO: 720 |
| Resource Partitioning | starch | brittle endosperm bt2 | 541902 | protein | Increase | SEQ ID NO: 721 | SEQ ID NO: 722 |
| Resource Partitioning | Starch | ae1 | 541992 | protein | Increase/Decrease | SEQ ID NO: 723 | SEQ ID NO: 724 |
| Resource Partitioning | Starch | Betl3 | 542003 | protein | Increase | SEQ ID NO: 725 | SEQ ID NO: 726 |
| Resource Partitioning | Starch | Betl4 | 542004 | protein | Increase | SEQ ID NO: 727 | SEQ ID NO: 728 |
| Resource Partitioning | Starch | sus1 | 542247 | protein | Increase | SEQ ID NO: 729 | SEQ ID NO: 730 |
| Resource Partitioning | starch | sbe1 | 542315 | protein | Increase/Decrease | SEQ ID NO: 731 | SEQ ID NO: 732 |
| Resource Partitioning | starch | sugary 1 | 542318 | protein | Increase/Decrease | SEQ ID NO: 733 | SEQ ID NO: 734 |

TABLE 23-continued

| Trait | Trait subcategory | Gene(s) | GeneID | GeneProduct | Expression Change | Gene SEQ ID | Protein SEQ ID |
|---|---|---|---|---|---|---|---|
| Resource Partitioning | starch | shrunken 1 | 542365 | protein | Increase | SEQ ID NO: 735 | SEQ ID NO: 736 |
| Resource Partitioning | Starch | Esr2 | 542448 | protein | Increase | SEQ ID NO: 737 | SEQ ID NO: 738 |
| Resource Partitioning | Starch | Betl1 | 542477 | protein | Increase | SEQ ID NO: 739 | SEQ ID NO: 740 |
| resource Partitioning | Starch | Betl2 | 542570 | protein | Increase | SEQ ID NO: 741 | SEQ ID NO: 742 |
| Resource Partitioning | starch | Miniature1; Mn1 | 542590 | protein | Increase | SEQ ID NO: 743 | SEQ ID NO: 744 |
| Resource Partitioning | starch | shrunken 2 | 542761 | protein | Increase | SEQ ID NO: 745 | SEQ ID NO: 746 |
| Resource Partitioning | Starch | bt1 | 732804 | protein | Increase | SEQ ID NO: 747 | SEQ ID NO: 748 |
| Resource Partitioning | Starch | Esr1 | 100037781 | protein | Increase | SEQ ID NO: 749 | SEQ ID NO: 750 |
| Resource Partitioning | starch | 6-phospho-fructokinase | 100191851 | protein | Increase | SEQ ID NO: 751 | SEQ ID NO: 752 |
| Resource Partitioning | Starch | APS1 | 542295 | protein | Increase | SEQ ID NO: 753 | SEQ ID NO: 754 |
| Resource Partitioning | starch | se1 | 103648177 | protein | Increase/Decrease | SEQ ID NO: 755 | SEQ ID NO: 756 |
| Resource Partitioning | Starch | wx1 | 109942318 | protein | Increase | SEQ ID NO: 757 | SEQ ID NO: 758 |
| Resource Partitioning | Starch | Esr3 | 109943596 | protein | Increase | SEQ ID NO: 759 | SEQ ID NO: 760 |
| Resource Partitioning | Starch | Zm INVINH1 | — | protein | Increase | | SEQ ID NO: 762 |

TABLE 24

| Type of regulation | Name of element | Sequence | SEQ ID |
|---|---|---|---|
| regulatory control by TF | ABFs binding site motif | CACGTGGC | SEQ ID NO: 763 |
| regulatory control by TF | ABRE binding site motif | (C/T)ACGTGGC | SEQ ID NO: 764 |
| regulatory control by TF | ABRE-like binding site motif | (C/G/T)ACGTG(G/T)(A/C) | SEQ ID NO: 765 |
| regulatory control by TF | ACE promoter motif | GACACGTAGA | SEQ ID NO: 766 |
| regulatory control by TF | AG binding site motif | TT(A/G/T)CC(A/T)(A/T)(A/T)(A/T)(A/T)(A/T)GG(A/C/T) | SEQ ID NO: 767 |
| regulatory control by TF | AG binding site in AP3 | CCATTTTTAGT | SEQ ID NO: 768 |
| regulatory control by TF | AG binding site in SUP | CCATTTTTGG | SEQ ID NO: 769 |
| regulatory control by TF | AGL1 binding site motif | NTT(A/G/T)CC(A/T)(A/T)(A/T)(A/T)NNGG(A/T)AAN | SEQ ID NO: 770 |
| regulatory control by TF | AG L2 binding site motif | NN(A/T)NCCA(A/T)(A/T)(A/T)(A/T)T(A/G)G(A/T)(A/T)AN | SEQ ID NO: 771 |
| regulatory control by TF | AGL3 binding site motif | TT(A/T)C(C/T)A(A/T)(A/T)(A/T)(A/T)T(A/G)G(A/T)AA | SEQ ID NO: 772 |
| regulatory control by TF | AP1 binding site in AP3 | CCATTTTTAG | SEQ ID NO: 773 |
| regulatory control by TF | AP1 binding site in SUP | CCATTTTTGG | SEQ ID NO: 774 |
| regulatory control by TF | ARF binding site motif | TGTCTC | SEQ ID NO: 775 |
| regulatory control by TF | ARF1 binding site motif | TGTCTC | SEQ ID NO: 776 |

TABLE 24-continued

| Type of regulation | Name of element | Sequence | SEQ ID |
|---|---|---|---|
| regulatory control by TF | ATH B1 binding site motif | CAAT(A/T)ATTG | SEQ ID NO: 777 |
| regulatory control by TF | ATH B2 binding site motif | CAAT(C/G)ATTG | SEQ ID NO: 778 |
| regulatory control by TF | ATH B5 binding site motif | CAATNATTG | SEQ ID NO: 779 |
| regulatory control by TF | ATH B6 binding site motif | CAATTATTA | SEQ ID NO: 780 |
| regulatory control by TF | AtMYB2 binding site in RD22 | CTAACCA | SEQ ID NO: 781 |
| regulatory control by TF | AtMYC2 binding site in RD22 | CACATG | SEQ ID NO: 782 |
| regulatory control by TF | Box II promoter motif | GGTTAA | SEQ ID NO: 783 |
| regulatory control by TF | CArG promoter motif | CC(A/T)(A/T)(A/T)(A/T)(A/T)(A/T)GG | SEQ ID NO: 784 |
| regulatory control by TF | CArG1 motif in AP3 | GTTTACATAAATGGAAAA | SEQ ID NO: 785 |
| regulatory control by TF | CArG2 motif in AP3 | CTTACCTTTCATGGATTA | SEQ ID NO: 786 |
| regulatory control by TF | CArG3 motif in AP3 | CTTTCCATTTTTAGTAAC | SEQ ID NO: 787 |
| regulatory control by TF | CBF1 binding site in cor15a | TGGCCGAC | SEQ ID NO: 788 |
| regulatory control by TF | CBF2 binding site motif | CCACGTGG | SEQ ID NO: 789 |
| regulatory control by TF | CCA1 binding site motif | AA(A/C)AATCT | SEQ ID NO: 790 |
| regulatory control by TF | CCA1 motif1 binding site in CAB1 | AAACAATCTA | SEQ ID NO: 791 |
| regulatory control by TF | CCA1 motif2 binding site in CAB1 | AAAAAAAATCTATGA | SEQ ID NO: 792 |
| regulatory control by TF | DPBF1&2 binding site motif | ACACNNG | SEQ ID NO: 793 |
| regulatory control by TF | DRE promoter motif | TACCGACAT | SEQ ID NO: 794 |
| regulatory control by TF | DREB1&2 binding site in rd29a | TACCGACAT | SEQ ID NO: 795 |
| regulatory control by TF | DRE-like promoter motif | (A/G/T)(A/G)CCGACN(A/T) | SEQ ID NO: 796 |
| regulatory control by TF | E2F binding site motif | TTTCCCGC | SEQ ID NO: 797 |
| regulatory control by TF | E2F/DP binding site in AtCDC6 | TTTCCCGC | SEQ ID NO: 798 |
| regulatory control by IF | E2F-varient binding site motif | TCTCCCGCC | SEQ ID NO: 799 |
| regulatory control by TF | EIL1 binding site in ERF1 | TTCAAGGGGCATGTATCTTGAA | SEQ ID NO: 800 |
| regulatory control by TF | EIL2 binding site in ERF1 | TTCAAGGGGCATGTATCTTGAA | SEQ ID NO: 801 |

TABLE 24-continued

| Type of regulation | Name of element | Sequence | SEQ ID |
|---|---|---|---|
| regulatory control by TF | EIL3 binding site in ERF1 | TTCAAGGGGGCATGTATCTTGAA | SEQ ID NO: 802 |
| regulatory control by TF | EIN3 binding site in ERF1 | GGATTCAAGGGGGCATGTATCTTGAATCC | SEQ ID NO: 803 |
| regulatory control by TF | ERE promoter motif | TAAGAGCCGCC | SEQ ID NO: 804 |
| regulatory control by TF | ERF1 binding site in AtCHI-B | GCCGCC | SEQ ID NO: 805 |
| regulatory control by IF | Evening Element promoter motif | AAAATATCT | SEQ ID NO: 806 |
| regulatory control by TF | GATA promoter motif | (A/T)GATA(G/A) | SEQ ID NO: 807 |
| regulatory control by TF | GBF1/2/3 binding site in ADH1 | CCACGTGG | SEQ ID NO: 808 |
| regulatory control by TF | G-box promoter motif | CACGTG | SEQ ID NO: 809 |
| regulatory control by TF | GCC-box promoter motif | GCCGCC | SEQ ID NO: 810 |
| regulatory control by TF | GT promoter motif | TGTGTGGTTAATATG | SEQ ID NO: 811 |
| regulatory control by TF | Hexamer promoter motif | CCGTCG | SEQ ID NO: 812 |
| regulatory control by TF | HSEs binding site motif | AGAANNTTCT | SEQ ID NO: 813 |
| regulatory control by TF | Ibox promoter motif | GATAAG | SEQ ID NO: 814 |
| regulatory control by TF | JASE1 motif in OPR1 | CGTCAATGAA | SEQ ID NO: 815 |
| regulatory control by TF | JASE2 motif in OPR2 | CATACGTCGTCAA | SEQ ID NO: 816 |
| regulatory control by TF | L1-box promoter motif | TAAATG(C/T)A | SEQ ID NO: 817 |
| regulatory control by TF | LS5 promoter motif | ACGTCATAGA | SEQ ID NO: 818 |
| regulatory control by TF | LS7 promoter motif | TCTACGTCAC | SEQ ID NO: 819 |
| regulatory control by TF | LTRE promoter motif | ACCGACA | SEQ ID NO: 820 |
| regulatory control by TF | MRE motif in CHS | TCTAACCTACCA | SEQ ID NO: 821 |
| regulatory control by TF | MYB binding site promoter | (A/C)ACC(A/T)A(A/C)C | SEQ ID NO: 822 |
| regulatory control by TF | MYB1 binding site motif | (A/C)TCC(A/T)ACC | SEQ ID NO: 823 |
| regulatory control by TF | MYB2 binding site motif | TAACT(G/C)GTT | SEQ ID NO: 824 |
| regulatory control by TF | MYB3 binding site motif | TAACTAAC | SEQ ID NO: 825 |
| regulatory control by TF | MYB4 binding site motif | A(A/C)C(A/T)A(A/C)C | SEQ ID NO: 826 |
| regulatory control by TF | Nonamer promoter motif | AGATCGACG | SEQ ID NO: 827 |

TABLE 24-continued

| Type of regulation | Name of element | Sequence | SEQ ID |
|---|---|---|---|
| regulatory control by TF | OBF4,5 binding site in GST6 | ATCTTATGTCATTGATGACGACCTCC | SEQ ID NO: 828 |
| regulatory control by TF | OBP-1,4,5 binding site in GST6 | TACACTTTTGG | SEQ ID NO: 829 |
| regulatory control by TF | OCS promoter motif | TGACG(C/T)AAG(C/G)(A/G)(A/C)T(G/T)ACG(C/T)(A/C)(A/C) | SEQ ID NO: 830 |
| regulatory control by TF | octamer promoter motif | CGCGGATC | SEQ ID NO: 831 |
| regulatory control by TF | PI promoter motif | GTGATCAC | SEQ ID NO: 832 |
| regulatory control by TF | PII promoter motif | TTGGTTTTGATCAAAACCAA | SEQ ID NO: 833 |
| regulatory control by TF | PRHA binding site in PAL1 | TAATTGACTCAATTA | SEQ ID NO: 834 |
| regulatory control by TF | RAV1-A binding site motif | CAACA | SEQ ID NO: 835 |
| regulatory control by TF | RAV1-B binding site motif | CACCTG | SEQ ID NO: 836 |
| regulatory control by TF | RY-repeat promoter motif | CATGCATG | SEQ ID NO: 837 |
| regulatory control by TF | SBP-box promoter motif | TNCGTACAA | SEQ ID NO: 838 |
| regulatory control by TF | T-box promoter motif | ACTTTG | SEQ ID NO: 839 |
| regulatory control by TF | TEF-box promoter motif | AGGGGCATAATGGTAA | SEQ ID NO: 840 |
| regulatory control by TF | TELO-box promoter motif | AAACCCTAA | SEQ ID NO: 841 |
| regulatory control by TF | TGA1 binding site motif | TGACGTGG | SEQ ID NO: 842 |
| regulatory control by TF | W-box promoter motif | TTGAC | SEQ ID NO: 843 |
| regulatory control by TF | Z-box promoter motif | ATACGTGT | SEQ ID NO: 844 |
| regulatory control by TF | AG binding site in SPL/NOZ | AAAACAGAATAGGAAA | SEQ ID NO: 845 |
| regulatory control by TF | Bellringer/ replumless/ pennywise binding site IN AG | AAATTAAA | SEQ ID NO: 846 |
| regulatory control by TF | Bellringer/ replumless/ pennywise binding site 2 in AG | AAATTAGT | SEQ ID NO: 847 |
| regulatory control by TF | Bellringer/ replumless/ pennywise binding site 3 in AG | ACTAATTT | SEQ ID NO: 848 |
| regulatory control by TF | AGL15 binding site in AtGA2ox6 | CCAATTTAATGG | SEQ ID NO: 849 |
| regulatory control by TF | ATB2/AtbZIP53/ AtbZ1 P44/GBF5 binding site in ProDH | ACTCAT | SEQ ID NO: 850 |

TABLE 24-continued

| Type of regulation | Name of element | Sequence | SEQ ID |
|---|---|---|---|
| regulatory control by TF | LFY binding site in AP3 | CTTAAACCCTAGGGGTAAT | SEQ ID NO: 851 |
| regulatory control by TF | SORLREP1 | TT(A/T)TACTAGT | SEQ ID NO: 852 |
| regulatory control by TF | SORLREP2 | ATAAAACGT | SEQ ID NO: 853 |
| regulatory control by TF | SORLREP3 | TGTATATAT | SEQ ID NO: 854 |
| regulatory control by TF | SORLREP4 | CTCCTAATT | SEQ ID NO: 855 |
| regulatory control by TF | SORLREP5 | TTGCATGACT | SEQ ID NO: 856 |
| regulatory control by TF | SORLIP1 | AGCCAC | SEQ ID NO: 857 |
| regulatory control by TF | SORLIP2 | GGGCC | SEQ ID NO: 858 |
| regulatory control by TF | SORLIP3 | CTCAAGTGA | SEQ ID NO: 859 |
| regulatory control by TF | SORLIP4 | GTATGATGG | SEQ ID NO: 860 |
| regulatory control by TF | SORLIP5 | GAGTGAG | SEQ ID NO: 861 |
| regulatory control by TF | ABFs binding site motif | CACGTGGC | SEQ ID NO: 862 |
| down | NdeI restriction site | GTTTAATTGAGTTGTCATATGTTAATAACGGTAT | SEQ ID NO: 863 |
| down | NdeI restriction site | ATACCGTTATTAACATATGACAACTCAATTAAAC | SEQ ID NO: 864 |
| up (auxin responsive) | 3xDR5 auxin-response element | CCGACAAAAGGCCGACAAAAGGCCGACAAAAGGT | SEQ ID NO: 865 |
| up (auxin responsive) | 3xDR5 auxin-response element | ACCTTTTGTCGGCCTTTTGTCGGCCTTTTGTCGG | SEQ ID NO: 866 |
| up (auxin responsive) | 6xDR5 auxin-responsive element | GCCGACAAAAGGCCGACAAAAGGCCGACAAAAGGCCGACAAAAGG CCGACAAAAGGCCGACAAAAGGT | SEQ ID NO: 867 |
| up (auxin responsive) | 6xDR5 auxin-responsive element | ACCTTTTGTCGGCCTTTTGTCGGCCTTTTGTCGG CCTTCTTTGTCGGCTTTGTCGGC | SEQ ID NO: 868 |
| up (auxin responsive) | 9xDR5 auxin-responsive element | CCGACAAAAGGCCGACAAAAGGCCGACAAAAGGCCGACAAAAGGC CGACAAAAGGCCGACAAAAGGCCGACAAAAGGCCGACAAAAGGCC GACAAAAGGT | SEQ ID NO: 869 |
| up (auxin responsive) | 9xDR5 auxin-responsive element | ACCTTTTGTCGGCCTTTTGTCGGCCTTTTGTCGG CCTTTTGTCGGCCTTTTGTCGGCCTTTTGTCGGC CTTTTGTCGG | SEQ ID NO: 870 |
| Cre recombinase recognition site | LoxP (wild-type 1) | ATAACTTCGTATAGCATACATTATACGAAGTTAT | SEQ ID NO: 871 |
| Cre recombinase recognition site | LoxP (wild-type 2) | ATAACTTCGTATAATGTATGCTATACGAAGTTAT | SEQ ID NO: 872 |
| Cre recombinase recognition site | Canonical LoxP | ATAACTTCGTATANNNTANNNTATACGAAGTTAT | SEQ ID NO: 873 |
| Cre recombinase recognition site | Lox 511 | ATAACTTCGTATAATGTATaCTATACGAAGTTAT | SEQ ID NO: 874 |

TABLE 24-continued

| Type of regulation | Name of element | Sequence | SEQ ID |
|---|---|---|---|
| Cre recombinase recognition site | Lox 5171 | ATAACTTCGTATAATGTgTaCTATACGAAGTTAT | SEQ ID NO: 875 |
| Cre recombinase recognition site | Lox 2272 | ATAACTTCGTATAAaGTATcCTATACGAAGTTAT | SEQ ID NO: 876 |
| Cre recombinase recognition site | M2 | ATAACTTCGTATAAgaaAccaTATACGAAGTTAT | SEQ ID NO: 877 |
| Cre recombinase recognition site | M3 | ATAACTTCGTATAtaaTACCATATACGAAGTTAT | SEQ ID NO: 878 |
| Cre recombinase recognition site | M7 | ATAACTTCGTATAAgaTAGAATATACGAAGTTAT | SEQ ID NO: 879 |
| Cre recombinase recognition site | M11 | ATAACTTCGTATAaGATAgaaTATACGAAGTTAT | SEQ ID NO: 880 |
| Cre recombinase recognition site | Lox 71 | taccgTTCGTATANNNTANNNTATACGAAGTTAT | SEQ ID NO: 881 |
| Cre recombinase recognition site | Lox 66 | ATAACTTCGTATANNNTANNNTATACGAAcggta | SEQ ID NO: 882 |
| maize ovule/early kernel transcript down-regulation | miR156j recognition site | GTGCTCTCTCTCTTCTGTCA | SEQ ID NO: 883 |
| maize ovule/early kernel transcript down-regulation | miR156j recognition site | CTGCTCTCTCTCTTCTGTCA | SEQ ID NO: 884 |
| maize ovule/early kernel transcript down-regulation | miR156j recognition site | TTGCTTACTCTCTTCTGTCA | SEQ ID NO: 885 |
| maize ovule/early kernel transcript down-regulation | miR156j recognition site | CCGCTCTCTCTCTTCTGTCA | SEQ ID NO: 886 |
| maize ovule/early kernel transcript down-regulation | miR159c recognition site | TGGAGCTCCCTTCATTCCAAT | SEQ ID NO: 887 |
| maize ovule/early kernel transcript down-regulation | miR159c recognition site | TCGAGTTCCCTTCATTCCAAT | SEQ ID NO: 888 |
| maize ovule/early kernel transcript down-regulation | miR159c recognition site | ATGAGCTCTCTTCAAACCAAA | SEQ ID NO: 889 |
| maize ovule/early kernel transcript down-regulation | miR159c recognition site | TGGAGCTCCCTTCATTCCAAG | SEQ ID NO: 890 |
| maize ovule/early kernel transcript down-regulation | miR159c recognition site | TAGAGCTTCCTTCAAACCAAA | SEQ ID NO: 891 |
| maize ovule/early kernel transcript down-regulation | miR159c recognition site | TGGAGCTCCATTCGATCCAAA | SEQ ID NO: 892 |
| maize ovule/early kernel transcript down-regulation | miR159c recognition site | AGCAGCTCCCTTCAAACCAAA | SEQ ID NO: 893 |
| maize ovule/early kernel transcript down-regulation | miR159c recognition site | CAGAGCTCCCTTCACTCCAAT | SEQ ID NO: 894 |
| maize ovule/early kernel transcript down-regulation | miR159c recognition site | TGGAGCTCCCTTCACTCCAAT | SEQ ID NO: 895 |

TABLE 24-continued

| Type of regulation | Name of element | Sequence | SEQ ID |
|---|---|---|---|
| maize ovule/early kernel transcript down-regulation | miR159c recognition site | TGGAGCTCCCTTCACTCCAAG | SEQ ID NO: 896 |
| maize ovule/early kernel transcript down-regulation | miR159c recognition site | TGGAGCTCCCTTTAATCCAAT | SEQ ID NO: 897 |
| maize embryo transcript down-regulation | miR166b recognition site | TTGGGATGAAGCCTGGTCCGG | SEQ ID NO: 898 |
| maize embryo transcript down-regulation | miR166b recognition site | CTGGGATGAAGCCTGGTCCGG | SEQ ID NO: 899 |
| maize embryo transcript down-regulation | miR166b recognition site | CTGGAATGAAGCCTGGTCCGG | SEQ ID NO: 900 |
| maize embryo transcript down-regulation | miR166b recognition site | CGGGATGAAGCCTGGTCCGG | SEQ ID NO: 901 |
| maize endosperm transcript down-regulation | miR167g recognition site | GAGATCAGGCTGGCAGCTTGT | SEQ ID NO: 902 |
| maize endosperm transcript down-regulation | miR167g recognition site | TAGATCAGGCTGGCAGCTTGT | SEQ ID NO: 903 |
| maize endosperm transcript down-regulation | miR167g recognition site | AAGATCAGGCTGGCAGCTTGT | SEQ ID NO: 904 |
| maize pollen transcript down-regulation | miR156i recognition site | GTGCTCTCTCTCTTCTGTCA | SEQ ID NO: 905 |
| maize pollen transcript down-regulation | miR156i recognition site | CTGCTCTCTCTCTTCTGTCA | SEQ ID NO: 906 |
| maize pollen transcript down-regulation | miR156i recognition site | TTGCTTACTCTCTTCTGTCA | SEQ ID NO: 907 |
| maize pollen transcript down-regulation | miR156i recognition site | CCGCTCTCTCTCTTCTGTCA | SEQ ID NO: 908 |
| maize pollen transcript down-regulation | mir160b-like recognition site | TGGCATGCAGGGAGCCAGGCA | SEQ ID NO: 909 |
| maize pollen transcript down-regulation | mir160b-like recognition site | AGGAATACAGGGAGCCAGGCA | SEQ ID NO: 910 |
| maize pollen transcript down-regulation | mir160b-like recognition site | GGGTTTACAGGGAGCCAGGCA | SEQ ID NO: 911 |
| maize pollen transcript down-regulation | mir160b-like recognition site | AGGCATACAGGGAGCCAGGCA | SEQ ID NO: 912 |
| maize pollen transcript down-regulation | miR393a recognition site | AAACAATGCGATCCCTTTGGA | SEQ ID NO: 913 |
| maize pollen transcript down-regulation | miR393a recognition site | AGACCATGCGATCCCTTTGGA | SEQ ID NO: 914 |
| maize pollen transcript down-regulation | miR393a recognition site | GGTCAGAGCGATCCCTTTGGC | SEQ ID NO: 915 |

TABLE 24-continued

| Type of regulation | Name of element | Sequence | SEQ ID |
|---|---|---|---|
| maize pollen transcript down-regulation | miR393a recognition site | AGACAATGCGATCCCTTTGGA | SEQ ID NO: 916 |
| maize pollen transcript down-regulation | miR396a recognition site | TCGTTCAAGAAAGCCTGTGGAA | SEQ ID NO: 917 |
| maize pollen transcript down-regulation | miR396a recognition site | CGTTCAAGAAAGCCTGTGGAA | SEQ ID NO: 918 |
| maize pollen transcript down-regulation | miR396a recognition site | TCGTTCAAGAAAGCATGTGGAA | SEQ ID NO: 919 |
| maize pollen transcript down-regulation | miR396a recognition site | ACGTTCAAGAAAGCTTGTGGAA | SEQ ID NO: 920 |
| maize pollen transcript down-regulation | miR396a recognition site | CGTTCAAGAAAGCCTGTGGAA | SEQ ID NO: 921 |
| maize male tissue transcript down-regulation | male tissue-specific siRNA element | GGACAACAAGCACCTTCTTGCCTTGCAAGGCCTCCCTTCCCTATG GTAGCCACTTGAGTGGATGACTTCACCTTAAAGCTATTGATTCCC TAAGTGCCAGACATAATAGGCTATACATTCTCTCTGGTGGCAACA ATGAGCCATTTTGGTTGGTGTGGTAGTCTATTATTGAGTTTTTTT TGGCACCGTACTCCCATGGAGAGTAGAAGACAAACTCTTCACCGT TGTAGTCGTTGATGGTATTGGTGGTGACGACATCCTTGGTGTGCA TGCACTGGTGAGTCACTGTTGTACTCGGCG | SEQ ID NO: 922 |
| maize male tissue transcript down-regulation | male tissue-specific siRNA element | GGACAACAAGCACCTTCTTGCCTTGCAAGGCCTCCCTTCCCTATG GTAGCCACTTGAGTGGATGACTTCACCTTAAAGCTATCGATTCCC TAAGTGCCAGACAT | SEQ ID NO: 923 |
| maize male tissue transcript down-regulation | male tissue-specific siRNA element | CTCTTCACCGTTGTAGTCGTTGATGGTATTGGTGGTGACGACATC CTTGGTGTGCATGCACTGGTGAGTCACTGTTGTAC | SEQ ID NO: 924 |
| maize male tissue transcript down-regulation | male tissue-specific siRNA element | GGACAACAAGCACCTTCTTGCCTTGCAAGGCCTCCCTTCCCTATG GTAGCCACTTGAGTGGATGACTTCACCTTAAAGCTATCGATTCCC TAAGTGCCAGACATCTCTTCACCGTTGTAGTCGTTGATGGTATTG GTGGTGACGACATCCTTGGTGTGCATGCACTGGTGAGTCACTGTT GTAC | SEQ ID NO: 925 |
| maize male tissue transcript down-regulation | male tissue-specific siRNA element | CTCTTCACCGTTGTAGTCGTTGATGGTATTGGTGGTGACGACATC CTTGGTGTGCATGCACTGGTGAGTCACTGTTGTACGGACAACAAG CACCTTCTTGCCTTGCAAGGCCTCCCTTCCCTATGGTAGCCACTT GAGTGGATGACTTCACCTTAAAGCTATCGATTCCCTAAGTGCCAG ACAT | SEQ ID NO: 926 |
| up (auxin reponsive; constitutive) | ocs enhancer (Agrobacterium sp.) | ACGTAAGCGCTTACGT | SEQ ID NO: 927 |
| up (auxin reponsive; constitutive) | 12-nt ocs orthologue (Zea mays) | GTAAGCGCTTAC | SEQ ID NO: 928 |
| up (nitrogen responsive) | AtNRE | AAGAGATGAGCTCTTGAGCAATGTAAAGGGTCAAGTTGTTTCT | SEQ ID NO: 929 |
| up (nitrogen responsive) | AtNRE | AGAAACAACTTGACCCTTTACATTGCTCAAGAGCTCATCTCTT | SEQ ID NO: 930 |
| up (auxin responsive) | 3xDR5 auxin-response element; RNA strand of RNA/DNA hybid | ACCUUUUGUCGGCCUUUUGUCGGCCUUUUGUCGG | SEQ ID NO: 931 |
| up (auxin responsive) | 3xDR5 auxin-response element; sticky-ended | TCGGTCCGACAAAAGGCCGACAAAAGGCGGACAAAAGG | SEQ ID NO: 932 |

TABLE 24-continued

| Type of regulation | Name of element | Sequence | SEQ ID |
|---|---|---|---|
| up (auxin responsive) | 3xDR5 auxin-response element; sticky-ended | ACCGACCTTTTGTCGGCCTTTTGTCGGCCTTTTGTCGG | SEQ ID NO: 933 |
| down or up (MAMP-responsive) | OsTBF1 uORF2 | ATGGGAGTAGAGGCGGGCGGCGGCTGCGGTGGGAGGGCGGTAGTC ACCGGATTCTACGTCTGGGGCTGGGAGTTCCTCACCGCCCTCCTG CTCTTCTCGGCCACCACCTCCTACTAG | SEQ ID NO: 934 |
| down or up (MAMP-responsive) | synthetic R-motif | AAAAAAAAAAAAAAA | SEQ ID NO: 935 |
| down or up (MAMP-responsive) | AtTBF1 R-motif | CACATACACACAAAAATAAAAAGA | SEQ ID NO: 936 |
| decreases upregulation | insulator | GAATATATATATATTC | SEQ ID NO: 937 |
| sequence modification | ZmEPSPS exon 1 with two point mutations and heterospecific lox sites | GTGAACAACCTTATGAAATTTGGGCGCATAACTTCGTATAGCATA CATTATACGAAGTTATAAAGAACTCGCCCTCAAGGGTTGATCTTA TGCCATCGTCATGATAAACAGTGGAGCACGGACGATCCTTTACGT TGTTTTTAACAAACTTTGTCAGAAAACTAGCATCATTAACTTCTT AATGACGATTTCACAACAAAAAAGGTAACCTCGCTACTAACATA ACAAAATACTTGTTGCTTATTAATTATATGTTTTTTAATCTTTGA TCAGGGGACAACAGTGGTTGATAACCTGTTGAACAGTGAGGATGT CCACTACATGCTCGGGGCCTTGAGGACTCTTGGTCTCTCTGTCGA AGCGGACAAAGCTGCCAAAAGAGCTGTAGTTGTTGGCTGTGGTGG AAAGTTCCCAGTTGAGGATTCAAAGAGGAAGTGCAGCTCTTCTT GGGGAATGCTGGAATTGCAATGCGGGCATTGACAGCAGCTGTTAC TGCTGCTGGTGGAAATGCAACGTATGTTTCCTCTCTTCTCTCTA CAATACTTGCATAACTTCGTATAAAGTATCCTATACGAAGTTATT GGAGTTAGTATGAAACCCATGGGTATGTCTAGT | SEQ ID NO: 938 |
| decreases upregulation | miniature inverted-repeat transposable element ("MITE") | TACTCCCTCCGTTTCITTTTATTAGTCGCTGGATAGTGCAATTTT GCACTATCCAGCGACTAATAAAAAGAAACGGAGGGAGTA | SEQ ID NO: 939 |
| decreases upregulation | miniature inverted-repeat transposable element ("MITE") | TACTCCCTCCGTTTCTTTTTATTAGTCGCTGGATAGTGCAAAATT GCACTATCCAGCGACTAATAAAAAGAAACGGAGGGAGTA | SEQ ID NO: 940 |
| up (constitutive) | G-box | ACACGTGACACGTGACACGTGACACGTG | SEQ ID NO: 941 |
| decreased transcript stability | mRNA destabilizing element (mammalian) | TTATTTATTTTATTTATTTTTATTTATTTTATTTATT | SEQ ID NO: 942 |
| decreased transcript stability | mRNA destabilizing element (Arabidopsis thaliana) | AATTTTAATTTTAATTTTAATTTTAATTTTAATTTT | SEQ ID NO: 943 |
| increased transcript stability | mRNA stabilizing element | TCTCTTTCTCTTTCTCTTTCTCTTTCTCTTTCTCTT | SEQ ID NO: 944 |
| down | SHAT1-repressor | ATTAAAAAAATAAATAAGATATTATTAAAAAAATAAATAAGATAT TATTAAAAAAATAAATAAGATATTATTAAAAAAATAAATAAGATA TT | SEQ ID NO: 945 |
| decreased transcript stability | SAUR mRNA destabilizing element | AGATCTAGGAGACTGACATAGATTGGAGGAGACATTTTGTATAAT AAGATCTAGGAGACTGACATAGATTGGAGGAGACATTTTGTATAA TA | SEQ ID NO: 946 |
| down by recruiting transcription factors interacting with PRC2 | CTCC | CTCC(T/A/G)CC(G/T/A) | SEQ ID NO: 947 |

TABLE 24-continued

| Type of regulation | Name of element | Sequence | SEQ ID |
|---|---|---|---|
| down by recruiting transcription factors interacting with PRC2 | CCG | (C/T/A)(G/T)C(C/A)(G/A)(C/A)C(G/T)(C/A) | SEQ ID NO: 948 |
| down by recruiting transcription factors interacting with PRC2 | G-box | (C/G)ACGTGGNN(G/A/C)(T/A) | SEQ ID NO: 949 |
| down by recruiting transcription factors interacting with PRC2 | GA repeat | A(G/A)A(G/A)AGA(G/A)(A/G) | SEQ ID NO: 950 |
| down by recruiting transcription factors interacting with PRC2 | AC-rich | CA(A/T/C)CA(C/A)CA(A/C/T) | SEQ ID NO: 951 |
| down by recruiting transcription factors interacting with PRC2 | Telobox | (A/G)AACCC(T/A)A(A/G) | SEQ ID NO: 952 |
| up (Pi starvation response) | P1BS | GNATATNC | SEQ ID NO: 953 |

All cited patents and patent publications referred to in this application are incorporated herein by reference in their entirety. All of the materials and methods disclosed and claimed herein can be made and used without undue experimentation as instructed by the above disclosure and illustrated by the examples. Although the materials and methods of this invention have been described in terms of embodiments and illustrative examples, it will be apparent to those of skill in the art that substitutions and variations can be applied to the materials and methods described herein without departing from the concept, spirit, and scope of the invention. For instance, while the particular examples provided illustrate the methods and embodiments described herein using a specific plant, the principles in these examples are applicable to any plant of interest; similarly, while the particular examples provided illustrate the methods and embodiments described herein using a particular sequence-specific nuclease such as Cas9, one of skill in the art would recognize that alternative sequence-specific nucleases (e. g., CRISPR nucleases other than Cas9, such as CasX, CasY, and Cpf1, zinc-finger nucleases, transcription activator-like effector nucleases, Argonaute proteins, and meganucleases) are useful in various embodiments. All such similar substitutes and modifications apparent to those skilled in the art are deemed to be within the spirit, scope, and concept of the invention as encompassed by the embodiments of the inventions recited herein and the specification and appended claims.

SEQUENCE LISTING (1023 sequences)

SEQ ID NO: 1 - RNA, 36 nt, artificial sequence
  synthetic construct
gcacuugaucaccuucccugguuuuagagcuaugcu

SEQ ID NO: 2 - RNA, 36 nt, artificial sequence
  synthetic construct
uccaccuccucgaucaccagguuuuagagcuaugcu

SEQ ID NO: 3 - RNA, 36 nt, artificial sequence
  synthetic construct
ggccucccagaaguagacguguuuuagagcuaugcu

SEQ ID NO: 4 - RNA, 36 nt, artificial sequence
  synthetic construct
gggaaggugaucaagugcaaguuuuagagcuaugcu

SEQ ID NO: 5 - RNA, 36 nt, artificial sequence
  synthetic construct
gccaccgucgaacccuuuggguuuuagagcuaugcu

SEQ ID NO: 6 - RNA, 36 nt, artificial sequence
  synthetic construct
guaaaugggcuucccguugaguuuuagagcuaugcu

SEQ ID NO: 7 - RNA, 36 nt, artificial sequence
  synthetic construct
gacagacucccguguucccuguuuuagagcuaugcu

SEQ ID NO: 8 - RNA, 36 nt, artificial sequence
  synthetic construct
gugaauucaggagcuggaggguuuuagagcuaugcu

SEQ ID NO: 9 - RNA, 36 nt, artificial sequence
  synthetic construct
guacuugcugagaugaccaaguuuuagagcuaugcu

SEQ ID NO: 10 - RNA, 36 nt, artificial sequence
  synthetic construct
gcaacaugugugaucugcucguuuuagagcuaugcu

SEQ ID NO: 11 - RNA, 36 nt, artificial sequence
  synthetic construct
uggccgggaggauucccaugguuuuagagcuaugcu

SEQ ID NO: 12 - RNA, 36 nt, artificial sequence
  synthetic construct
augguucaugcagugcacggguuuuagagcuaugcu

SEQ ID NO: 13 - RNA, 36 nt, artificial sequence
  synthetic construct
gcucgaggacgaacucggugguuuuagagcuaugcu

SEQ ID NO: 14 - RNA, 36 nt, artificial sequence
  synthetic construct
auguacuggagggagcugggguuuuagagcuaugcu

SEQ ID NO: 15 - RNA, 36 nt, artificial sequence
  synthetic construct
uagaauguauaauuacccguguuuuagagcuaugcu

SEQ ID NO: 16 - RNA, 36 nt, artificial sequence
  synthetic construct
cgggccucccgggagccaucguuuuagagcuaugcu

SEQ ID NO: 17 - RNA, 36 nt, artificial sequence
  synthetic construct
caagcaccuggggcgucugcguuuuagagcuaugcu

SEQ ID NO: 18 - RNA, 36 nt, artificial sequence
  synthetic construct
gagaucagaucuugccgaugguuuuagagcuaugcu

SEQ ID NO: 19 - RNA, 36 nt, artificial sequence
  synthetic construct
gaaggugaucuugcuauugaguuuuagagcuaugcu

SEQ ID NO: 20 - RNA, 36 nt, artificial sequence
  synthetic construct
gaagaugagugagcuugcguguuuuagagcuaugcu

SEQ ID NO: 21 - DNA, 720 bp, Zea mays
gaacagtgccgcagtggcgctgatcttgtatgctatcctgcaatcgtggtgaacttatttcttttatatcctttactcccatgaaaaggctagtaatctttctcgatgtaacatcgtccagcactgctattaccgtgtggtccatccgacagtctggctgaacacatcatacgatctatggagcaaaaatctatcttccctgttctttaatgaaggacgtcattttcattagtatgatctaggaatgttgcaacttgcaaggaggcgtttctttctttgaatttaactaactcgttgagtggccctgtttctcggacgtaaggcctttgctgctccacacatgtccattcgaattttaccgtgtttagcaagggcgaaaagtttgcatcttgatgatttagcttgactatgcgattgctttcctggacccgtgcagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatacaacaactcgcggttgacttgcgccttcttggcggcttatctgtcttaggggcagactcccgtgttccctcggatctttggccacgaggctggagggta

SEQ ID NO: 22 - DNA, 163 bp, Zea mays
atgcgattgctttcctggacccgtgcagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggcca

SEQ ID NO: 23 - RNA, 36 nt, artificial sequence; identical to SEQ ID NO: 3
  synthetic construct

SEQ ID NO: 24 - DNA, 19 bp, artificial sequence
  synthetic construct
gaacagtgccgcagtggcg

SEQ ID NO: 25 - DNA, 19 bp, artificial sequence
  synthetic construct
taccctccagcctcgtggc

SEQ ID NO: 26 - DNA, 23 bp, artificial sequence
  synthetic construct
actatgcgattgctttcctggac

SEQ ID NO: 27 - DNA, 24 bp, artificial sequence
  synthetic construct
accgcgagttgttgtatcatatct

SEQ ID NO: 28 - DNA, 230 bp, artificial sequence
  synthetic construct
actatgcgattgctttcctggacccgtgcagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatacaacaactcgcggt

SEQ ID NO: 29 - DNA, 606 bp, Zea mays
aaccggtgtaatacatactaagggctagtttgggaaccctggttttctaaggaattttatttttccaaaaaaaatagtttatttttccttcggaaattaggaatctcttataaaattcgagttcccaaactattcctaatatatatatcatactctccatcagtctatatatagattacatatagtaagtatagagtatctcgctatcacatagtgccactaatcttctggagtgtaccagttgtataaatatctatcagtatcagcactactgtttgctgaataccccaaaactctctgcttgacttctcttccctaacctttgcactgtccaaaatggcttcctgatcccctcacttcctcgaatcattctaagaagaaactcaagccgctaccattaggggcagattaattgctgcactttcagataatctaccatggccactgtgaacaactggctcgctttctccctctccccgcaggagctgccgccctcccagacgacggactccacgctcatctcggccgccaccgccgaccatgtctccggcgatgtctgcttcaacatcccccaaggtagcatctatctatctggcgacatacgtg

SEQ ID NO: 30 - DNA, 254 bp, Zea mays
aaccggtgtaatacatactaagggctagtttgggaaccctggttttctaaggaattttatttttccaaaaaaaatagtttatttttccttcggaaattaggaatctcttataaaattcgagttcccaaactattcctaatatatatatcatactctccatcagtctatatatagattacatatagtaagtatagagtatctcgctatcacatagtgccactaatcttctggagtgtaccagttgtataaatatc

SEQ ID NO: 31 - RNA, 36 nt, artificial sequence
  synthetic construct
aagagauuccuaauuuccgaguuuuagagcuaugcu

SEQ ID NO: 32 - DNA, 20 bp, artificial sequence
  synthetic construct
gggaaccctggttttctaag

SEQ ID NO: 33 - DNA, 22 bp, artificial sequence
  synthetic construct
gcaaacagtagtgctgatactg

SEQ ID NO: 34 - DNA, 248 bp, artificial sequence
  synthetic construct
gggaaccctggttttctaaggaattttatttttccaaaaaaaatagtttatttttccttcggaaattaggaatctcttataaaattcgagttcccaaactattcctaatatatatatcatactctccatcagtctatatatagattacatatagtaagtatagagtatctcgctatcacatagtgccactaatcttctggagtgtaccagttgtataaatatctatcagtatcagcactactgtttgc

SEQ ID NO: 35 - DNA, 255 bp, Brassica oleracea
gaaacctaccagtctctcctttgaagaagacatgaacaaaattagccacggcgctctatctcggccttccggtaacgtttcttgttcaatattgttgtattagctttcatatgaccaaattcttcataattaaagatcggtatagaagtcatagattacatatatgtacatttgcacgggtgagtttgcaacaaatgtcgttttactttgtgaaatttaatccctaatcatgttttaggaatgctgcaccgtgcc

SEQ ID NO: 36 - DNA, 40 bp, Brassica oleracea
atgaacaaaattagccacggcgctctatctcggccttccg

SEQ ID NO: 37 - DNA, 17 bp, Brassica oleracea
gaatgctgcaccgtgcc

SEQ ID NO: 38 - RNA, 36 nt, artificial sequence
  synthetic construct
gaacaagaaacguuaccggaguuuuagagcuaugcu

SEQ ID NO: 39 - DNA, 23 bp, artificial sequence
  synthetic construct
gaaacctaccagtctctcctttg

SEQ ID NO: 40 - DNA, 20 bp, artificial sequence
  synthetic construct
ggcacggtgcagcattccta

SEQ ID NO: 41 - DNA, 206 bp, Brassica oleracea
ccgatggtcttcagttctcttccttgttatggtctcccccacgagatcctcaacaacataaggtacttaacaataataaataaagcctcagatgtctcatccatgaaccggtgctgattgtctttctccttaggatcaagtcgttgcttatgtcgaatactttggtcggttcacatcagagcaattccctgatgatattgctgagg

SEQ ID NO: 42 - DNA, 60 bp, Brassica oleracea
ccgatggtcttcagttctcttccttgttatggtctcccccacgagatcctcaacaacata

SEQ ID NO: 43 - DNA, 72 bp, Brassica oleracea
aggatcaagtcgttgcttatgtcgaatactttggtcggttcacatcagagcaattccctgatgatattgctg

SEQ ID NO: 44 - RNA, 36 nt, artificial sequence
  synthetic construct
ucgugggggagaccauaacaguuuuagagcuaugcu

SEQ ID NO: 45 - DNA, 20 bp, artificial sequence
  synthetic construct
ccgatggtcttcagttctct

SEQ ID NO: 46 - DNA, 20 bp, artificial sequence
  synthetic construct
cctcagcaatatcatcaggg

SEQ ID NO: 47 - DNA, 230 bp, artificial sequence; identical to SEQ ID NO: 28
  synthetic construct

SEQ ID NO: 48 - DNA, 230 bp, artificial sequence; identical to SEQ ID NO: 28
  synthetic construct

SEQ ID NO: 49 - DNA, 230 bp, artificial sequence; identical to SEQ ID NO: 28
  synthetic construct

SEQ ID NO: 50 - DNA, 230 bp, artificial sequence; identical to SEQ ID NO: 28
  synthetic construct

SEQ ID NO: 51 - DNA, 230 bp, artificial sequence; identical to SEQ ID NO: 28
  synthetic construct

SEQ ID NO: 52 - DNA, 230 bp, artificial sequence; identical to SEQ ID NO: 28
  synthetic construct

SEQ ID NO: 53 - DNA, 230 bp, artificial sequence; identical to SEQ ID NO: 28
  synthetic construct

SEQ ID NO: 54 - DNA, 230 bp, artificial sequence; identical to SEQ ID NO: 28
  synthetic construct

SEQ ID NO: 55 - DNA, 230 bp, artificial sequence; identical to SEQ ID NO: 28
  synthetic construct

SEQ ID NO: 56 - DNA, 230 bp, artificial sequence; identical to SEQ ID NO: 28
  synthetic construct

SEQ ID NO: 57 - DNA, 230 bp, artificial sequence; identical to SEQ ID NO: 28
  synthetic construct

SEQ ID NO: 58 - DNA, 230 bp, artificial sequence; identical to SEQ ID NO: 28
  synthetic construct

SEQ ID NO: 59 - DNA, 230 bp, artificial sequence; identical to SEQ ID NO: 28
  synthetic construct

SEQ ID NO: 60 - DNA, 230 bp, artificial sequence; identical to SEQ ID NO: 28
  synthetic construct

SEQ ID NO: 61 - DNA, 230 bp, artificial sequence; identical to SEQ ID NO: 28
  synthetic construct

SEQ ID NO: 62 - DNA, 230 bp, artificial sequence; identical to SEQ ID NO: 28
  synthetic construct

SEQ ID NO: 63 - DNA, 230 bp, artificial sequence; identical to SEQ ID NO: 28
  synthetic construct

SEQ ID NO: 64 - DNA, 230 bp, artificial sequence; identical to SEQ ID NO: 28
  synthetic construct

SEQ ID NO: 65 - DNA, 230 bp, artificial sequence; identical to SEQ ID NO: 28
  synthetic construct

SEQ ID NO: 66 - DNA, 230 bp, artificial sequence; identical to SEQ ID NO: 28
  synthetic construct

SEQ ID NO: 67 - DNA, 230 bp, artificial sequence; identical to SEQ ID NO: 28
  synthetic construct

SEQ ID NO: 68 - DNA, 230 bp, artificial sequence; identical to SEQ ID NO: 28
  synthetic construct

SEQ ID NO: 69 - DNA, 230 bp, artificial sequence; identical to SEQ ID NO: 28
  synthetic construct

SEQ ID NO: 70 - DNA, 230 bp, artificial sequence; identical to SEQ ID NO: 28
  synthetic construct

SEQ ID NO: 71 - DNA, 230 bp, artificial sequence; identical to SEQ ID NO: 28
  synthetic construct

SEQ ID NO: 72 - DNA, 230 bp, artificial sequence; identical to SEQ ID NO: 28
  synthetic construct

SEQ ID NO: 73 - DNA, 230 bp, artificial sequence; identical to SEQ ID NO: 28
  synthetic construct

SEQ ID NO: 74 - DNA, 230 bp, artificial sequence; identical to SEQ ID NO: 28
  synthetic construct

SEQ ID NO: 75 - DNA, 230 bp, artificial sequence; identical to SEQ ID NO: 28
  synthetic construct

SEQ ID NO: 76 - DNA, 230 bp, artificial sequence; identical to SEQ ID NO: 28
  synthetic construct

SEQ ID NO: 77 - DNA, 230 bp, artificial sequence; identical to SEQ ID NO: 28
  synthetic construct

SEQ ID NO: 78 - DNA, 230 bp, artificial sequence; identical to SEQ ID NO: 28
  synthetic construct

SEQ ID NO: 79 - DNA, 230 bp, artificial sequence; identical to SEQ ID NO: 28
  synthetic construct

SEQ ID NO: 80 - DNA, 230 bp, artificial sequence; identical to SEQ ID NO: 28
  synthetic construct

SEQ ID NO: 81 - DNA, 230 bp, artificial sequence; identical to SEQ ID NO: 28
  synthetic construct

SEQ ID NO: 82 - DNA, 230 bp, artificial sequence; identical to SEQ ID NO: 28
  synthetic construct

SEQ ID NO: 83 - DNA, 230 bp, artificial sequence; identical to SEQ ID NO: 28
  synthetic construct

SEQ ID NO: 84 - DNA, 230 bp, artificial sequence; identical to SEQ ID NO: 28
  synthetic construct

SEQ ID NO: 85 - DNA, 230 bp, artificial sequence; identical to SEQ ID NO: 28
  synthetic construct

SEQ ID NO: 86 - DNA, 230 bp, artificial sequence; identical to SEQ ID NO: 28
  synthetic construct

SEQ ID NO: 87 - DNA, 230 bp, artificial sequence; identical to SEQ ID NO: 28
  synthetic construct

SEQ ID NO: 88 - DNA, 230 bp, artificial sequence; identical to SEQ ID NO: 28
  synthetic construct

SEQ ID NO: 89 - DNA, 230 bp, artificial sequence; identical to SEQ ID NO: 28
  synthetic construct

SEQ ID NO: 90 - DNA, 230 bp, artificial sequence; identical to SEQ ID NO: 28
  synthetic construct

SEQ ID NO: 91 - DNA, 230 bp, artificial sequence; identical to SEQ ID NO: 28
  synthetic construct

SEQ ID NO: 92 - DNA, 230 bp, artificial sequence; identical to SEQ ID NO: 28
  synthetic construct

SEQ ID NO: 93 - DNA, 230 bp, artificial sequence; identical to SEQ ID NO: 28
  synthetic construct

SEQ ID NO: 94 - DNA, 230 bp, artificial sequence; identical to SEQ ID NO: 28
  synthetic construct

SEQ ID NO: 95 - DNA, 230 bp, artificial sequence; identical to SEQ ID NO: 28
  synthetic construct

SEQ ID NO: 96 - DNA, 230 bp, artificial sequence; identical to SEQ ID NO: 28
  synthetic construct

SEQ ID NO: 97 - DNA, 230 bp, artificial sequence; identical to SEQ ID NO: 28
  synthetic construct

SEQ ID NO: 98 - DNA, 230 bp, artificial sequence; identical to SEQ ID NO: 28
  synthetic construct

SEQ ID NO: 99 - DNA, 230 bp, artificial sequence; identical to SEQ ID NO: 28
  synthetic construct

SEQ ID NO: 100 - DNA, 230 bp, artificial sequence; identical to SEQ ID NO: 28
  synthetic construct

SEQ ID NO: 101 - DNA, 230 bp, artificial sequence; identical to SEQ ID NO: 28
  synthetic construct

SEQ ID NO: 102 - DNA, 230 bp, artificial sequence; identical to SEQ ID NO: 28
  synthetic construct

SEQ ID NO: 103 - DNA, 230 bp, artificial sequence; identical to SEQ ID NO: 28
  synthetic construct

SEQ ID NO: 104 - DNA, 230 bp, artificial sequence; identical to SEQ ID NO: 28
  synthetic construct

SEQ ID NO: 105 - DNA, 230 bp, artificial sequence; identical to SEQ ID NO: 28
  synthetic construct

SEQ ID NO: 106 - DNA, 230 bp, artificial sequence; identical to SEQ ID NO: 28
  synthetic construct

SEQ ID NO: 107 - DNA, 230 bp, artificial sequence; identical to SEQ ID NO: 28
  synthetic construct

SEQ ID NO: 108 - DNA, 230 bp, artificial sequence; identical to SEQ ID NO: 28
  synthetic construct

SEQ ID NO: 109 - DNA, 230 bp, artificial sequence; identical to SEQ ID NO: 28
  synthetic construct

SEQ ID NO: 110 - DNA, 230 bp, artificial sequence; identical to SEQ ID NO: 28
  synthetic construct

SEQ ID NO: 111 - DNA, 230 bp, artificial sequence; identical to SEQ ID NO: 28
  synthetic construct

SEQ ID NO: 112 - DNA, 230 bp, artificial sequence; identical to SEQ ID NO: 28
  synthetic construct

SEQ ID NO: 113 - DNA, 230 bp, artificial sequence; identical to SEQ ID NO: 28
  synthetic construct

SEQ ID NO: 114 - DNA, 230 bp, artificial sequence; identical to SEQ ID NO: 28
  synthetic construct

SEQ ID NO: 115 - DNA, 230 bp, artificial sequence; identical to SEQ ID NO: 28
  synthetic construct

SEQ ID NO: 116 - DNA, 230 bp, artificial sequence; identical to SEQ ID NO: 28
  synthetic construct

SEQ ID NO: 117 - DNA, 230 bp, artificial sequence; identical to SEQ ID NO: 28
  synthetic construct

SEQ ID NO: 118 - DNA, 230 bp, artificial sequence; identical to SEQ ID NO: 28
  synthetic construct

SEQ ID NO: 119 - DNA, 230 bp, artificial sequence; identical to SEQ ID NO: 28
  synthetic construct

SEQ ID NO: 120 - DNA, 230 bp, artificial sequence; identical to SEQ ID NO: 28
  synthetic construct

SEQ ID NO: 121 - DNA, 230 bp, artificial sequence; identical to SEQ ID NO: 28
  synthetic construct

SEQ ID NO: 122 - DNA, 230 bp, artificial sequence; identical to SEQ ID NO: 28
  synthetic construct

SEQ ID NO: 123 - DNA, 230 bp, artificial sequence; identical to SEQ ID NO: 28
  synthetic construct

SEQ ID NO: 124 - DNA, 230 bp, artificial sequence; identical to SEQ ID NO: 28
  synthetic construct

SEQ ID NO: 125 - DNA, 230 bp, artificial sequence; identical to SEQ ID NO: 28
  synthetic construct

SEQ ID NO: 126 - DNA, 230 bp, artificial sequence; identical to SEQ ID NO: 28
  synthetic construct

SEQ ID NO: 127 - DNA, 230 bp, artificial sequence; identical to SEQ ID NO: 28
  synthetic construct

SEQ ID NO: 128 - DNA, 230 bp, artificial sequence; identical to SEQ ID NO: 28
  synthetic construct

SEQ ID NO: 129 - DNA, 230 bp, artificial sequence; identical to SEQ ID NO: 28
  synthetic construct

SEQ ID NO: 130 - DNA, 230 bp, artificial sequence; identical to SEQ ID NO: 28
  synthetic construct

SEQ ID NO: 131 - DNA, 230 bp, artificial sequence; identical to SEQ ID NO: 28
  synthetic construct

SEQ ID NO: 132 - DNA, 230 bp, artificial sequence; identical to SEQ ID NO: 28
  synthetic construct

SEQ ID NO: 133 - DNA, 230 bp, artificial sequence; identical to SEQ ID NO: 28
  synthetic construct

SEQ ID NO: 134 - DNA, 230 bp, artificial sequence; identical to SEQ ID NO: 28
  synthetic construct

SEQ ID NO: 135 - DNA, 230 bp, artificial sequence; identical to SEQ ID NO: 28
  synthetic construct

SEQ ID NO: 136 - DNA, 3079 bp, artificial sequence
  synthetic construct
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtggaattctaaagatctaaaataaatggtaaaatgtcaaatcaaaactaggctgcagtatgcagagcagagtcatgatgatactacttactacaccgattcttgtgtgcagaaaaatatgttaaaataattgaatctttctctagccaaatttgacaacaatgtacaccgttcatattgagagacgatgcttcttgtttgctttcggtggaagctgcatatactcaacattactccttcagcgagttttccaactgagtcccacattgcccagacctaacacggtattcttgtttataatgaaatgtgccaccacatggattgaagcaagagacgttctagggttttagagctagaaatagcaagttaaaataaggctagtccgttatcaacttgaaaaagtggcaccgagtcggtgctttttttggatccggcgcgccgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 137 - DNA, 20 bp, artificial sequence
  synthetic construct
gaagcaagagacgttctagg

SEQ ID NO: 138 - DNA, 76 bp, artificial sequence
  synthetic construct
gttttagagctagaaatagcaagttaaaataaggctagtccgttatcaacttgaaaaagtggcaccgagtcggtgc

SEQ ID NO: 139 - DNA, 96 bp, artificial sequence
  synthetic construct
gaagcaagagacgttctagggttttagagctagaaatagcaagttaaaataaggctagtccgttatcaacttgaaaaagtggcaccgagtcggtgc

SEQ ID NO: 140 - DNA, 8569 bp, artificial sequence
  synthetic construct
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattctaaagatctggcgcgccggcccgggctggttattgtttttgtcaatgagctatcttttagtcttatgttattggtgaatctgtccttaagttgcatcatttaacacatctcctcattagagaaaaaaattcttccctaaacgattggtagtaaaaacatctaataagaaataagaaagaaaaattaggaaaaaggaaagttcattaaaaaaaatattttgaattattttttaaaaaatatctaaatattttttaaatgaataattttatataaactgtaactaaatgtatacaagtaatgtatgttaaaaaaatacttgaaaaatctactgaaaatatatcttacaaggtgaaattaaataagaaagaatttagtggaataattatgattttatttaaaaaataattattaaagatttttttgctccataataagaaaacttttcaattattcttttctggtccataataaaaaaaatctagcatgacagcttttccatagatttttaataatgtaaaagcagccgacttcaggcaatggatagtggggcccgtatcaacttcggacgctccacttgcaacggggtgggcccaatataacaacgacgtcgtaacagataaagcgaagattgaaggtgcatgtgactccgtcaagattacgaaaccgccaactaccacgcaaattgcaattctcaatttcctagaaggactctccgaaaatgcatccaataccaaatattacccgtgtcataggcaccaagtgacaccatacatgaacacgcgtcacaatatgactggagaagggttccacaccttatgctataaaacgccccacacccctcctccttccttcgcagttcaattccaatatattccattctctctgtgtatttccctacctctcccttcaaggttagtcgatttcttctgtttttcttcttcgttctttccatgaattgtgtatgttctttgatcaatacgatgttgatttgattgtgttttgtttggtttcatcgatcttcaattttcataatcagattcagcttttattatctttacaacaacgtccttaatttgatgattctttaatcgtagatttgctctaattagagctttttcatgtcagatccctttacaacaagccttaattgttgattcattaatcgtagattagggcttttttcattgattacttcagatccgttaaacgtaaccatagatcagggctttttcatgaattacttcagatccgttaaacaacagccttattttttatacttctgtggtttttcaagaaattgttcagatccgttgacaaaaagccttattcgttgattctatatcgtttttcgagagatattgctcagatgtgttagcaactgccttgtttgttgattctattgccgtggattagggttttttttcacgagattgcttcagatccgtacttaagattacgtaatggattttgattctgatttatctgtgattgttgactcgacaggatcggtaccccatggataagaagtactctatcggactcgatatcggaactaactctgtgggatgggctgtgatcaccgatgagtacaaggtgccatctaagaagttcaaggttctcggaaacaccgataggcactctatcaagaaaaaccttatcggtgctctcctcttcgattctggtgaaactgctgaggctaccagactcaagagaaccgctagaagaaggtacaccagaagaaagaacaggatctgctacctccaagagatcttctctaacgagatggctaaagtggatgattcattcttccacaggctcgaagagtcattcctcgtggaagaagataagaagcacgagaggcaccctatcttcggaaacatcgttgatgaggtggcataccacgagaagtaccctactatctaccacctcagaaagaagctcgttgattctactgataaggctgatctcaggctcatctacctcgctctcgctcacatgatcaagttcagaggacacttcctcatcgagggtgatctcaaccctgataactctgatgtggataagttgttcatccagctcgtgcagacctacaaccagcttttcgaagagaaccctatcaacgcttcaggtgtggatgctaaggctatcctctctgctaggctctctaagtcaagaaggcttgagaacctcattgctcagctccctggtgagaagaagaacggacttttcggaaacttgatcgctctctctctcggactcacccctaacttcaagtctaacttcgatctcgctgaggatgcaaagctccagctctcaaaggatacctacgatgatgatctcgataacctcctcgctcagatcggagatcagtacgctgatttgttcctcgctgctaagaacctctctgatgctatcctcctcagtgatatcctcagagtgaacaccgagatcaccaaggctccactctcagcttctatgatcaagagatacgatgagcaccaccaggatctcacacttctcaaggctcttgttagacagcagctcccagagaagtacaaagagattttcttcgatcagtctaagaacggatacgctggttacatcgatggtggtgcatctcaagaagagttctacaagttcatcaagcctatcctcgagaagatggatggaaccgaggaactcctcgtgaagctcaatagagaggatcttctcagaaagcagaggaccttcgataacggatctatccctcatcagatccacctcggagagttgcacgctatccttagaaggcaagaggatttctacccattcctcaaggataacagggaaaagattgagaagattctcaccttcagaatcccttactacgtgggacctctcgctagaggaaactcaagattcgcttggatgaccagaaagtctgaggaaaccatcaccccttggaacttcgaagaggtggtggataagggtgctagtgctcagtctttcatcgagaggatgaccaacttcgataagaaccttccaaacgagaaggtgctccctaagcactctttgctctacgagtacttcaccgtgtacaacgagttgaccaaggttaagtacgtgaccgagggaatgaggaagcctgcttttttgtcaggtgagcaaaagaaggctatcgttgatctcttgttcaagaccaacagaaaggtgaccgtgaagcagctcaaagaggattacttcaagaaaatcgagtgcttcgattcagttgagatttctggtgttgaggataggttcaacgcatctctcggaacctaccacgatctcctcaagatcattaaggataaggatttcttggataacgaggaaaacgaggatatcttggaggatatcgttcttaccctcaccctctttgaagatagagagatgattgaagaaaggctcaagacctacgctcatctcttcgatgataaggtgatgaagcagttgaagagaagaagatacactggttggggaaggctctcaagaaagctcattaacggaatcagggataagcagtctggaaagacaatccttgatttcctcaagtctgatggattcgctaacagaaacttcatgcagctcatccacgatgattctctcacctttaaagaggatatccagaaggctcaggtttcaggacagggtgatagtctccatgagcatatcgctaacctcgctggatctcctgcaatcaagaagggaatcctccagactgtgaaggttgtggatgagttggtgaaggtgatgggaaggcataagcctgagaacatcgtgatcgaaatggctagagagaaccagaccactcagaagggacagaagaactctagggaaaggatgaagaggatcgaggaaggtatcaaagagcttggatctcagatcctcaaagagcaccctgttgagaacactcagctccagaatgagaagctctacctctactacctccagaacggaagggatatgtatgtggatcaagagttggatatcaacaggctctctgattacgatgttgatcatatcgtgccacagtcattcttgaaggatgattctatcgataacaaggtgctcaccaggtctgataagaacaggggtaagagtgataacgtgccaagtgaagaggttgtgaagaaaatgaagaactattggaggcagctcctcaacgctaagctcatcactcagagaaagttcgataacttgactaaggctgagaggggaggactctctgaattggataaggcaggattcatcaagaggcagcttgtggaaaccaggcagatcactaagcacgttgcacagatcctcgattctaggatgaacaccaagtacgatgagaacgataagttgatcagggaagtgaaggttatcaccctcaagtcaaagctcgtgtctgatttcagaaaggatttccaattctacaaggtgagggaaatcaacaactaccaccacgctcacgatgcttaccttaacgctgttgttggaaccgctctcatcaagaagtatcctaagctcgagtcagagttcgtgtacggtgattacaaggtgtacgatgtgaggaagatgatcgctaagtctgagcaagagatcggaaaggctaccgctaagtatttcttctactctaacatcatgaatttcttcaagaccgagattaccctcgctaacggtgagatcagaaagaggccactcatcgagacaaacggtgaaacaggtgagatcgtgtgggataagggaagggatttcgctaccgttagaaaggtgctctctatgccacaggtgaacatcgttaagaaaaccgaggtgcagaccggtggattctctaaagagtctatcctccctaagaggaactctgataagctcattgctaggaagaaggattgggaccctaagaaatacggtggtttcgattctcctaccgtggcttactctgttctcgttgtggctaaggttgagaagggaaagagtaagaagctcaagtctgttaaggaacttctcggaatcactatcatggaaaggtcatctttcgagaagaacccaatcgatttcctcgaggctaagggatacaaagaggttaagaaggatctcatcatcaagctcccaaagtactcactcttcgaactcgagaacggtagaaagaggatgctcgcttctgctggtgagcttcaaaagggaaacgagcttgctctcccatctaagtacgttaactttctttacctcgcttctcactacgagaagttgaagggatctccagaagataacgagcagaagcaacttttcgttgagcagcacaagcactacttggatgagatcatcgagcagatctctgagttctctaaaagggtgatcctcgctgatgcaaacctcgataaggtgttgtctgcttacaacaagcacagagataagcctatcagggaacaggcagagaacatcatccatctcttcacccttaccaacctcggtgctcctgctgctttcaagtacttcgatacaaccatcgataggaagagatacacctctaccaaagaagtgctcgatgctaccctcatccatcagtctatcactggactctacgagactaggatcgatctctcacagctcggtggtgattcaagggctgatcctaagaagaagaggaaggtttgagcggccgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggatccgcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 141 - DNA, 4104 bp, artificial sequence
  synthetic construct
atggataagaagtactctatcggactcgatatcggaactaactctgtgggatgggctgtgatcaccgatgagtacaaggtgccatctaagaagttcaaggttctcggaaacaccgataggcactctatcaagaaaaaccttatcggtgctctcctcttcgattctggtgaaactgctgaggctaccagactcaagagaaccgctagaagaaggtacaccagaagaaagaacaggatctgctacctccaagagatcttctctaacgagatggctaaagtggatgattcattcttccacaggctcgaagagtcattcctcgtggaagaagataagaagcacgagaggcaccctatcttcggaaacatcgttgatgaggtggcataccacgagaagtaccctactatctaccacctcagaaagaagctcgttgattctactgataaggctgatctcaggctcatctacctcgctctcgctcacatgatcaagttcagaggacacttcctcatcgagggtgatctcaaccctgataactctgatgtggataagttgttcatccagctcgtgcagacctacaaccagcttttcgaagagaaccctatcaacgcttcaggtgtggatgctaaggctatcctctctgctaggctctctaagtcaagaaggcttgagaacctcattgctcagctccctggtgagaagaagaacggacttttcggaaacttgatcgctctctctctcggactcacccctaacttcaagtctaacttcgatctcgctgaggatgcaaagctccagctctcaaaggatacctacgatgatgatctcgataacctcctcgctcagatcggagatcagtacgctgatttgttcctcgctgctaagaacctctctgatgctatcctcctcagtgatatcctcagagtgaacaccgagatcaccaaggctccactctcagcttctatgatcaagagatacgatgagcaccaccaggatctcacacttctcaaggctcttgttagacagcagctcccagagaagtacaaagagattttcttcgatcagtctaagaacggatacgctggttacatcgatggtggtgcatctcaagaagagttctacaagttcatcaagcctatcctcgagaagatggatggaaccgaggaactcctcgtgaagctcaatagagaggatcttctcagaaagcagaggaccttcgataacggatctatccctcatcagatccacctcggagagttgcacgctatccttagaaggcaagaggatttctacccattcctcaaggataacagggaaaagattgagaagattctcaccttcagaatcccttactacgtgggacctctcgctagaggaaactcaagattcgcttggatgaccagaaagtctgaggaaaccatcaccccttggaacttcgaagaggtggtggataagggtgctagtgctcagtctttcatcgagaggatgaccaacttcgataagaaccttccaaacgagaaggtgctccctaagcactctttgctctacgagtacttcaccgtgtacaacgagttgaccaaggttaagtacgtgaccgagggaatgaggaagcctgcttttttgtcaggtgagcaaaagaaggctatcgttgatctcttgttcaagaccaacagaaaggtgaccgtgaagcagctcaaagaggattacttcaagaaaatcgagtgcttcgattcagttgagatttctggtgttgaggataggttcaacgcatctctcggaacctaccacgatctcctcaagatcattaaggataaggatttcttggataacgaggaaaacgaggatatcttggaggatatcgttcttaccctcaccctctttgaagatagagagatgattgaagaaaggctcaagacctacgctcatctcttcgatgataaggtgatgaagcagttgaagagaagaagatacactggttggggaaggctctcaagaaagctcattaacggaatcagggataagcagtctggaaagacaatccttgatttcctcaagtctgatggattcgctaacagaaacttcatgcagctcatccacgatgattctctcacctttaaagaggatatccagaaggctcaggtttcaggacagggtgatagtctccatgagcatatcgctaacctcgctggatctcctgcaatcaagaagggaatcctccagactgtgaaggttgtggatgagttggtgaaggtgatgggaaggcataagcctgagaacatcgtgatcgaaatggctagagagaaccagaccactcagaagggacagaagaactctagggaaaggatgaagaggatcgaggaaggtatcaaagagcttggatctcagatcctcaaagagcaccctgttgagaacactcagctccagaatgagaagctctacctctactacctccagaacggaagggatatgtatgtggatcaagagttggatatcaacaggctctctgattacgatgttgatcatatcgtgccacagtcattcttgaaggatgattctatcgataacaaggtgctcaccaggtctgataagaacaggggtaagagtgataacgtgccaagtgaagaggttgtgaagaaaatgaagaactattggaggcagctcctcaacgctaagctcatcactcagagaaagttcgataacttgactaaggctgagaggggaggactctctgaattggataaggcaggattcatcaagaggcagcttgtggaaaccaggcagatcactaagcacgttgcacagatcctcgattctaggatgaacaccaagtacgatgagaacgataagttgatcagggaagtgaaggttatcaccctcaagtcaaagctcgtgtctgatttcagaaaggatttccaattctacaaggtgagggaaatcaacaactaccaccacgctcacgatgcttaccttaacgctgttgttggaaccgctctcatcaagaagtatcctaagctcgagtcagagttcgtgtacggtgattacaaggtgtacgatgtgaggaagatgatcgctaagtctgagcaagagatcggaaaggctaccgctaagtatttcttctactctaacatcatgaatttcttcaagaccgagattaccctcgctaacggtgagatcagaaagaggccactcatcgagacaaacggtgaaacaggtgagatcgtgtgggataagggaagggatttcgctaccgttagaaaggtgctctctatgccacaggtgaacatcgttaagaaaaccgaggtgcagaccggtggattctctaaagagtctatcctccctaagaggaactctgataagctcattgctaggaagaaggattgggaccctaagaaatacggtggtttcgattctcctaccgtggcttactctgttctcgttgtggctaaggttgagaagggaaagagtaagaagctcaagtctgttaaggaacttctcggaatcactatcatggaaaggtcatctttcgagaagaacccaatcgatttcctcgaggctaagggatacaaagaggttaagaaggatctcatcatcaagctcccaaagtactcactcttcgaactcgagaacggtagaaagaggatgctcgcttctgctggtgagcttcaaaagggaaacgagcttgctctcccatctaagtacgttaactttctttacctcgcttctcactacgagaagttgaagggatctccagaagataacgagcagaagcaacttttcgttgagcagcacaagcactacttggatgagatcatcgagcagatctctgagttctctaaaagggtgatcctcgctgatgcaaacctcgataaggtgttgtctgcttacaacaagcacagagataagcctatcagggaacaggcagagaacatcatccatctcttcacccttaccaacctcggtgctcctgctgctttcaagtacttcgatacaaccatcgataggaagagatacacctctaccaaagaagtgctcgatgctaccctcatccatcagtctatcactggactctacgagactaggatcgatctctcacagctcggtggtgat

SEQ ID NO: 142 - protein, 1368 aa, Streptococcus pyogenes [sequence omitted]

SEQ ID NO: 143 - DNA, 21 bp, artificial sequence
  synthetic construct
cctaagaagaagaggaaggtt

SEQ ID NO: 144 - protein, 7 aa, artificial sequence
  synthetic construct
PKKKRKV

SEQ ID NO: 145 - DNA, 4137 bp, artificial sequence
  synthetic construct
atggataagaagtactctatcggactcgatatcggaactaactctgtgggatgggctgtgatcaccgatgagtacaaggtgccatctaagaagttcaaggttctcggaaacaccgataggcactctatcaagaaaaaccttatcggtgctctcctcttcgattctggtgaaactgctgaggctaccagactcaagagaaccgctagaagaaggtacaccagaagaaagaacaggatctgctacctccaagagatcttctctaacgagatggctaaagtggatgattcattcttccacaggctcgaagagtcattcctcgtggaagaagataagaagcacgagaggcaccctatcttcggaaacatcgttgatgaggtggcataccacgagaagtaccctactatctaccacctcagaaagaagctcgttgattctactgataaggctgatctcaggctcatctacctcgctctcgctcacatgatcaagttcagaggacacttcctcatcgagggtgatctcaaccctgataactctgatgtggataagttgttcatccagctcgtgcagacctacaaccagcttttcgaagagaaccctatcaacgcttcaggtgtggatgctaaggctatcctctctgctaggctctctaagtcaagaaggcttgagaacctcattgctcagctccctggtgagaagaagaacggacttttcggaaacttgatcgctctctctctcggactcacccctaacttcaagtctaacttcgatctcgctgaggatgcaaagctccagctctcaaaggatacctacgatgatgatctcgataacctcctcgctcagatcggagatcagtacgctgatttgttcctcgctgctaagaacctctctgatgctatcctcctcagtgatatcctcagagtgaacaccgagatcaccaaggctccactctcagcttctatgatcaagagatacgatgagcaccaccaggatctcacacttctcaaggctcttgttagacagcagctcccagagaagtacaaagagattttcttcgatcagtctaagaacggatacgctggttacatcgatggtggtgcatctcaagaagagttctacaagttcatcaagcctatcctcgagaagatggatggaaccgaggaactcctcgtgaagctcaatagagaggatcttctcagaaagcagaggaccttcgataacggatctatccctcatcagatccacctcggagagttgcacgctatccttagaaggcaagaggatttctacccattcctcaaggataacagggaaaagattgagaagattctcaccttcagaatcccttactacgtgggacctctcgctagaggaaactcaagattcgcttggatgaccagaaagtctgaggaaaccatcaccccttggaacttcgaagaggtggtggataagggtgctagtgctcagtctttcatcgagaggatgaccaacttcgataagaaccttccaaacgagaaggtgctccctaagcactctttgctctacgagtacttcaccgtgtacaacgagttgaccaaggttaagtacgtgaccgagggaatgaggaagcctgcttttttgtcaggtgagcaaaagaaggctatcgttgatctcttgttcaagaccaacagaaaggtgaccgtgaagcagctcaaagaggattacttcaagaaaatcgagtgcttcgattcagttgagatttctggtgttgaggataggttcaacgcatctctcggaacctaccacgatctcctcaagatcattaaggataaggatttcttggataacgaggaaaacgaggatatcttggaggatatcgttcttaccctcaccctctttgaagatagagagatgattgaagaaaggctcaagacctacgctcatctcttcgatgataaggtgatgaagcagttgaagagaagaagatacactggttggggaaggctctcaagaaagctcattaacggaatcagggataagcagtctggaaagacaatccttgatttcctcaagtctgatggattcgctaacagaaacttcatgcagctcatccacgatgattctctcacctttaaagaggatatccagaaggctcaggtttcaggacagggtgatagtctccatgagcatatcgctaacctcgctggatctcctgcaatcaagaagggaatcctccagactgtgaaggttgtggatgagttggtgaaggtgatgggaaggcataagcctgagaacatcgtgatcgaaatggctagagagaaccagaccactcagaagggacagaagaactctagggaaaggatgaagaggatcgaggaaggtatcaaagagcttggatctcagatcctcaaagagcaccctgttgagaacactcagctccagaatgagaagctctacctctactacctccagaacggaagggatatgtatgtggatcaagagttggatatcaacaggctctctgattacgatgttgatcatatcgtgccacagtcattcttgaaggatgattctatcgataacaaggtgctcaccaggtctgataagaacaggggtaagagtgataacgtgccaagtgaagaggttgtgaagaaaatgaagaactattggaggcagctcctcaacgctaagctcatcactcagagaaagttcgataacttgactaaggctgagaggggaggactctctgaattggataaggcaggattcatcaagaggcagcttgtggaaaccaggcagatcactaagcacgttgcacagatcctcgattctaggatgaacaccaagtacgatgagaacgataagttgatcagggaagtgaaggttatcaccctcaagtcaaagctcgtgtctgatttcagaaaggatttccaattctacaaggtgagggaaatcaacaactaccaccacgctcacgatgcttaccttaacgctgttgttggaaccgctctcatcaagaagtatcctaagctcgagtcagagttcgtgtacggtgattacaaggtgtacgatgtgaggaagatgatcgctaagtctgagcaagagatcggaaaggctaccgctaagtatttcttctactctaacatcatgaatttcttcaagaccgagattaccctcgctaacggtgagatcagaaagaggccactcatcgagacaaacggtgaaacaggtgagatcgtgtgggataagggaagggatttcgctaccgttagaaaggtgctctctatgccacaggtgaacatcgttaagaaaaccgaggtgcagaccggtggattctctaaagagtctatcctccctaagaggaactctgataagctcattgctaggaagaaggattgggaccctaagaaatacggtggtttcgattctcctaccgtggcttactctgttctcgttgtggctaaggttgagaagggaaagagtaagaagctcaagtctgttaaggaacttctcggaatcactatcatggaaaggtcatctttcgagaagaacccaatcgatttcctcgaggctaagggatacaaagaggttaagaaggatctcatcatcaagctcccaaagtactcactcttcgaactcgagaacggtagaaagaggatgctcgcttctgctggtgagcttcaaaagggaaacgagcttgctctcccatctaagtacgttaactttctttacctcgcttctcactacgagaagttgaagggatctccagaagataacgagcagaagcaacttttcgttgagcagcacaagcactacttggatgagatcatcgagcagatctctgagttctctaaaagggtgatcctcgctgatgcaaacctcgataaggtgttgtctgcttacaacaagcacagagataagcctatcagggaacaggcagagaacatcatccatctcttcacccttaccaacctcggtgctcctgctgctttcaagtacttcgatacaaccatcgataggaagagatacacctctaccaaagaagtgctcgatgctaccctcatccatcagtctatcactggactctacgagactaggatcgatctctcacagctcggtggtgattcaagggctgatcctaagaagaagaggaaggtt

SEQ ID NO: 146 - protein, 1379 aa, artificial sequence
  synthetic construct
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSRADPKKKRKV

SEQ ID NO: 147 - protein, 13 aa, artificial sequence
  synthetic construct
GRKKRRQRRRPPQ

SEQ ID NO: 148 - protein, 12 aa, artificial sequence
  synthetic construct
GRKKRRQRRRPQ

SEQ ID NO: 149 - protein, 11 aa, artificial sequence
  synthetic construct
YGRKKRRQRRR

SEQ ID NO: 150 - protein, 18 aa, artificial sequence
  synthetic construct
KLALKLALKALKAALKLA

SEQ ID NO: 151 - protein, 16 aa, artificial sequence
  synthetic construct
RQIRIWFQNRRMRWRR

SEQ ID NO: 152 - protein, 17 aa, artificial sequence
  synthetic construct
CSIPPEVKFNKPFVYLI

SEQ ID NO: 153 - protein, 30 aa, artificial sequence
  synthetic construct
RRRQRRKKRGGDIMGEWGNEIFGAIAGFLG

SEQ ID NO: 154 - protein, 13 aa, artificial sequence
  synthetic construct
FVQWFSKFLGRIL

SEQ ID NO: 155 - protein, 18 aa, artificial sequence
  synthetic construct
LLIILRRRIRKQAHAHSK

SEQ ID NO: 156 - protein, 24 aa, artificial sequence
  synthetic construct
LGTYTQDFNKFHTFPQTAIGVGAP

SEQ ID NO: 157 - protein, 30 aa, artificial sequence
  synthetic construct
GAAEAAARVYDLGLRRLRQRRRLRRERVRA

SEQ ID NO: 158 - protein, 27 aa, artificial sequence
  synthetic construct
MGLGLHLLVLAAALQGAWSQPKKKRKV

SEQ ID NO: 159 - protein, 18 aa, artificial sequence
  synthetic construct
RQIKIWFQNRRMKWKKGG

SEQ ID NO: 160 - protein, 8 aa, artificial sequence
  synthetic construct
RRRRRRRR

SEQ ID NO: 161 - protein, 9 aa, artificial sequence
  synthetic construct
RRRRRRRRR

SEQ ID NO: 162 - protein, 30 aa, artificial sequence
  synthetic construct
KKLFKKILKYLKKLFKKILKYLKKKKKKKK

SEQ ID NO: 163 - DNA, 14548 bp, artificial sequence
  synthetic construct
  misc_feature (13426)..(13426)
  misc_feature (13426)..(13426): n is a, c, g, or t
agtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcatgatatatctcccaatttgtgtagggcttattatgcacgcttaaaaataataaaagcagacttgacctgatagtttggctgtgagcaattatgtgcttagtgcatctaatcgcttgagttaacgccggcgaagcggcgtcggcttgaacgaatttctagctagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttcccccatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacatgtcataacaagaagccatgaaaaccgccactgcgccgttaccaccgctgcgttcggtcaaggttctggaccagttgcgtgacggcagttacgctacttgcattacagcttacgaaccgaacgaggcttatgtccactgggttcgtgcccgaattgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgacatgattacgaattcaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcgaattcggcgcgccatggataagaagtactctatcggactcgatatcggaactaactctgtgggatgggctgtgatcaccgatgagtacaaggtgccatctaagaagttcaaggttctcggaaacaccgataggcactctatcaagaaaaaccttatcggtgctctcctcttcgattctggtgaaactgctgaggctaccagactcaagagaaccgctagaagaaggtacaccagaagaaagaacaggatctgctacctccaagagatcttctctaacgagatggctaaagtggatgattcattcttccacaggctcgaagagtcattcctcgtggaagaagataagaagcacgagaggcaccctatcttcggaaacatcgttgatgaggtggcataccacgagaagtaccctactatctaccacctcagaaagaagctcgttgattctactgataaggctgatctcaggctcatctacctcgctctcgctcacatgatcaagttcagaggacacttcctcatcgagggtgatctcaaccctgataactctgatgtggataagttgttcatccagctcgtgcagacctacaaccagcttttcgaagagaaccctatcaacgcttcaggtgtggatgctaaggctatcctctctgctaggctctctaagtcaagaaggcttgagaacctcattgctcagctccctggtgagaagaagaacggacttttcggaaacttgatcgctctctctctcggactcacccctaacttcaagtctaacttcgatctcgctgaggatgcaaagctccagctctcaaaggatacctacgatgatgatctcgataacctcctcgctcagatcggagatcagtacgctgatttgttcctcgctgctaagaacctctctgatgctatcctcctcagtgatatcctcagagtgaacaccgagatcaccaaggctccactctcagcttctatgatcaagagatacgatgagcaccaccaggatctcacacttctcaaggctcttgttagacagcagctcccagagaagtacaaagagattttcttcgatcagtctaagaacggatacgctggttacatcgatggtggtgcatctcaagaagagttctacaagttcatcaagcctatcctcgagaagatggatggaaccgaggaactcctcgtgaagctcaatagagaggatcttctcagaaagcagaggaccttcgataacggatctatccctcatcagatccacctcggagagttgcacgctatccttagaaggcaagaggatttctacccattcctcaaggataacagggaaaagattgagaagattctcaccttcagaatcccttactacgtgggacctctcgctagaggaaactcaagattcgcttggatgaccagaaagtctgaggaaaccatcaccccttggaacttcgaagaggtggtggataagggtgctagtgctcagtctttcatcgagaggatgaccaacttcgataagaaccttccaaacgagaaggtgctccctaagcactctttgctctacgagtacttcaccgtgtacaacgagttgaccaaggttaagtacgtgaccgagggaatgaggaagcctgcttttttgtcaggtgagcaaaagaaggctatcgttgatctcttgttcaagaccaacagaaaggtgaccgtgaagcagctcaaagaggattacttcaagaaaatcgagtgcttcgattcagttgagatttctggtgttgaggataggttcaacgcatctctcggaacctaccacgatctcctcaagatcattaaggataaggatttcttggataacgaggaaaacgaggatatcttggaggatatcgttcttaccctcaccctctttgaagatagagagatgattgaagaaaggctcaagacctacgctcatctcttcgatgataaggtgatgaagcagttgaagagaagaagatacactggttggggaaggctctcaagaaagctcattaacggaatcagggataagcagtctggaaagacaatccttgatttcctcaagtctgatggattcgctaacagaaacttcatgcagctcatccacgatgattctctcacctttaaagaggatatccagaaggctcaggtttcaggacagggtgatagtctccatgagcatatcgctaacctcgctggatctcctgcaatcaagaagggaatcctccagactgtgaaggttgtggatgagttggtgaaggtgatgggaaggcataagcctgagaacatcgtgatcgaaatggctagagagaaccagaccactcagaagggacagaagaactctagggaaaggatgaagaggatcgaggaaggtatcaaagagcttggatctcagatcctcaaagagcaccctgttgagaacactcagctccagaatgagaagctctacctctactacctccagaacggaagggatatgtatgtggatcaagagttggatatcaacaggctctctgattacgatgttgatcatatcgtgccacagtcattcttgaaggatgattctatcgataacaaggtgctcaccaggtctgataagaacaggggtaagagtgataacgtgccaagtgaagaggttgtgaagaaaatgaagaactattggaggcagctcctcaacgctaagctcatcactcagagaaagttcgataacttgactaaggctgagaggggaggactctctgaattggataaggcaggattcatcaagaggcagcttgtggaaaccaggcagatcactaagcacgttgcacagatcctcgattctaggatgaacaccaagtacgatgagaacgataagttgatcagggaagtgaaggttatcaccctcaagtcaaagctcgtgtctgatttcagaaaggatttccaattctacaaggtgagggaaatcaacaactaccaccacgctcacgatgcttaccttaacgctgttgttggaaccgctctcatcaagaagtatcctaagctcgagtcagagttcgtgtacggtgattacaaggtgtacgatgtgaggaagatgatcgctaagtctgagcaagagatcggaaaggctaccgctaagtatttcttctactctaacatcatgaatttcttcaagaccgagattaccctcgctaacggtgagatcagaaagaggccactcatcgagacaaacggtgaaacaggtgagatcgtgtgggataagggaagggatttcgctaccgttagaaaggtgctctctatgccacaggtgaacatcgttaagaaaaccgaggtgcagaccggtggattctctaaagagtctatcctccctaagaggaactctgataagctcattgctaggaagaaggattgggaccctaagaaatacggtggtttcgattctcctaccgtggcttactctgttctcgttgtggctaaggttgagaagggaaagagtaagaagctcaagtctgttaaggaacttctcggaatcactatcatggaaaggtcatctttcgagaagaacccaatcgatttcctcgaggctaagggatacaaagaggttaagaaggatctcatcatcaagctcccaaagtactcactcttcgaactcgagaacggtagaaagaggatgctcgcttctgctggtgagcttcaaaagggaaacgagcttgctctcccatctaagtacgttaactttctttacctcgcttctcactacgagaagttgaagggatctccagaagataacgagcagaagcaacttttcgttgagcagcacaagcactacttggatgagatcatcgagcagatctctgagttctctaaaagggtgatcctcgctgatgcaaacctcgataaggtgttgtctgcttacaacaagcacagagataagcctatcagggaacaggcagagaacatcatccatctcttcacccttaccaacctcggtgctcctgctgctttcaagtacttcgatacaaccatcgataggaagagatacacctctaccaaagaagtgctcgatgctaccctcatccatcagtctatcactggactctacgagactaggatcgatctctcacagctcggtggtgattcaagggctgatcctaagaagaagaggaaggtttgaggcgcgccgagctccaggcctcccagctttcgtccgtatcatcggtttcgacaacgttcgtcaagttcaatgcatcagtttcattgcccacacaccagaatcctactaagtttgagtattatggcattggaaaagctgttttcttctatcatttgttctgcttgtaatttactgtgttctttcagtttttgttttcggacatcaaaatgcaaatggatggataagagttaataaatgatatggtccttttgttcattctcaaattattattatctgttgtttttactttaatgggttgaatttaagtaagaaaggaactaacagtgtgatattaaggtgcaatgttagacatataaaacagtctttcacctctctttggttatgtcttgaattggtttgtttcttcacttatctgtgtaatcaagtttactatgagtctatgatcaagtaattatgcaatcaagttaagtacagtataggcttgagctccctaggctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattggaagcaagagacgttctagggttttagagctagaaatagcaagttaaaataaggctagtccgttatcaacttgaaaaagtggcaccgagtcggtgctttttttctagacccagctttcttgtacaaagttggcattacctaggcccgggcctgaggacgcgtccatggttaattaagacgtccggaccgactagtggatcctctagagtcgacctgcaggcatgcaagcttcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcaatcccactatccttcgcaagacccttttaagggggaagttcatttcatttggagaggacacgctgaaatcaccagtctctctgtacaaatcnatctctctctataatattgtgtaagtagttcccagataagggaattagggttcttatagggtttcgctcagctgttgagcatataagaaacccttagtcgatagatctgttggggatctaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatgacccaacttagtatgtatttgtatttgtaaaatacttctatcaataaaatttctaattcctaaaaccaaaatccaggggtaccgaacaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaa

SEQ ID NO: 164 - DNA, 14548 bp, artificial sequence
  synthetic construct
  misc_feature (13426)..(13426): n is a, c, g, or t
agtactttgatccaacccctccgctgctatagtgcagtcggcttctgacgttcagtgcagccgtcttctgaaaacgacatgtcgcacaagtcctaagttacgcgacaggctgccgccctgcccttttcctggcgttttcttgtcgcgtgttttagtcgcataaagtagaatacttgcgactagaaccggagacattacgccatgaacaagagcgccgccgctggcctgctgggctatgcccgcgtcagcaccgacgaccaggacttgaccaaccaacgggccgaactgcacgcggccggctgcaccaagctgttttccgagaagatcaccggcaccaggcgcgaccgcccggagctggccaggatgcttgaccacctacgccctggcgacgttgtgacagtgaccaggctagaccgcctggcccgcagcacccgcgacctactggacattgccgagcgcatccaggaggccggcgcgggcctgcgtagcctggcagagccgtgggccgacaccaccacgccggccggccgcatggtgttgaccgtgttcgccggcattgccgagttcgagcgttccctaatcatcgaccgcacccggagcgggcgcgaggccgccaaggcccgaggcgtgaagtttggcccccgccctaccctcaccccggcacagatcgcgcacgcccgcgagctgatcgaccaggaaggccgcaccgtgaaagaggcggctgcactgcttggcgtgcatcgctcgaccctgtaccgcgcacttgagcgcagcgaggaagtgacgcccaccgaggccaggcggcgcggtgccttccgtgaggacgcattgaccgaggccgacgccctggcggccgccgagaatgaacgccaagaggaacaagcatgaaaccgcaccaggacggccaggacgaaccgtttttcattaccgaagagatcgaggcggagatgatcgcggccgggtacgtgttcgagccgcccgcgcacgtctcaaccgtgcggctgcatgaaatcctggccggtttgtctgatgccaagctggcggcctggccggccagcttggccgctgaagaaaccgagcgccgccgtctaaaaaggtgatgtgtatttgagtaaaacagcttgcgtcatgcggtcgctgcgtatatgatgcgatgagtaaataaacaaatacgcaaggggaacgcatgaaggttatcgctgtacttaaccagaaaggcgggtcaggcaagacgaccatcgcaacccatctagcccgcgccctgcaactcgccggggccgatgttctgttagtcgattccgatccccagggcagtgcccgcgattgggcggccgtgcgggaagatcaaccgctaaccgttgtcggcatcgaccgcccgacgattgaccgcgacgtgaaggccatcggccggcgcgacttcgtagtgatcgacggagcgccccaggcggcggacttggctgtgtccgcgatcaaggcagccgacttcgtgctgattccggtgcagccaagcccttacgacatatgggccaccgccgacctggtggagctggttaagcagcgcattgaggtcacggatggaaggctacaagcggcctttgtcgtgtcgcgggcgatcaaaggcacgcgcatcggcggtgaggttgccgaggcgctggccgggtacgagctgcccattcttgagtcccgtatcacgcagcgcgtgagctacccaggcactgccgccgccggcacaaccgttcttgaatcagaacccgagggcgacgctgcccgcgaggtccaggcgctggccgctgaaattaaatcaaaactcatttgagttaatgaggtaaagagaaaatgagcaaaagcacaaacacgctaagtgccggccgtccgagcgcacgcagcagcaaggctgcaacgttggccagcctggcagacacgccagccatgaagcgggtcaactttcagttgccggcggaggatcacaccaagctgaagatgtacgcggtacgccaaggcaagaccattaccgagctgctatctgaatacatcgcgcagctaccagagtaaatgagcaaatgaataaatgagtagatgaattttagcggctaaaggaggcggcatggaaaatcaagaacaaccaggcaccgacgccgtggaatgccccatgtgtggaggaacgggcggttggccaggcgtaagcggctgggttgtctgccggccctgcaatggcactggaacccccaagcccgaggaatcggcgtgacggtcgcaaaccatccggcccggtacaaatcggcgcggcgctgggtgatgacctggtggagaagttgaaggccgcgcaggccgcccagcggcaacgcatcgaggcagaagcacgccccggtgaatcgtggcaagcggccgctgatcgaatccgcaaagaatcccggcaaccgccggcagccggtgcgccgtcgattaggaagccgcccaagggcgacgagcaaccagattttttcgttccgatgctctatgacgtgggcacccgcgatagtcgcagcatcatggacgtggccgttttccgtctgtcgaagcgtgaccgacgagctggcgaggtgatccgctacgagcttccagacgggcacgtagaggtttccgcagggccggccggcatggccagtgtgtgggattacgacctggtactgatggcggtttcccatctaaccgaatccatgaaccgataccgggaagggaagggagacaagcccggccgcgtgttccgtccacacgttgcggacgtactcaagttctgccggcgagccgatggcggaaagcagaaagacgacctggtagaaacctgcattcggttaaacaccacgcacgttgccatgcagcgtacgaagaaggccaagaacggccgcctggtgacggtatccgagggtgaagccttgattagccgctacaagatcgtaaagagcgaaaccgggcggccggagtacatcgagatcgagctagctgattggatgtaccgcgagatcacagaaggcaagaacccggacgtgctgacggttcaccccgattactttttgatcgatcccggcatcggccgttttctctaccgcctggcacgccgcgccgcaggcaaggcagaagccagatggttgttcaagacgatctacgaacgcagtggcagcgccggagagttcaagaagttctgtttcaccgtgcgcaagctgatcgggtcaaatgacctgccggagtacgatttgaaggaggaggcggggcaggctggcccgatcctagtcatgcgctaccgcaacctgatcgagggcgaagcatccgccggttcctaatgtacggagcagatgctagggcaaattgccctagcaggggaaaaaggtcgaaaaggtctctttcctgtggatagcacgtacattgggaacccaaagccgtacattgggaaccggaacccgtacattgggaacccaaagccgtacattgggaaccggtcacacatgtaagtgactgatataaaagagaaaaaaggcgatttttccgcctaaaactctttaaaacttattaaaactcttaaaacccgcctggcctgtgcataactgtctggccagcgcacagccgaagagctgcaaaaagcgcctacccttcggtcgctgcgctccctacgccccgccgcttcgcgtcggcctatcgcggccgctggccgctcaaaaatggctggcctacggccaggcaatctaccagggcgcggacaagccgcgccgtcgccactcgaccgccggcgcccacatcaaggcaccctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgcatgatatatctcccaatttgtgtagggcttattatgcacgcttaaaaataataaaagcagacttgacctgatagtttggctgtgagcaattatgtgcttagtgcatctaatcgcttgagttaacgccggcgaagcggcgtcggcttgaacgaatttctagctagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttcccccatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacatgtcataacaagaagccatgaaaaccgccactgcgccgttaccaccgctgcgttcggtcaaggttctggaccagttgcgtgacggcagttacgctacttgcattacagcttacgaaccgaacgaggcttatgtccactgggttcgtgcccgaattgatcacaggcagcaacgctctgtcatcgttacaatcaacatgctaccctccgcgagatcatccgtgtttcaaacccggcagcttagttgccgttcttccgaatagcatcggtaacatgagcaaagtctgccgccttacaacggctctcccgctgacgccgtcccggactgatgggctgcctgtatcgagtggtgattttgtgccgagctgccggtcggggagctgttggctggctggtggcaggatatattgtggtgtaaacaaattgacgcttagacaacttaataacacattgcggacgtttttaatgtactgaattaacgccgaattgctctagccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgacatgattacgaattcaaaaattacggatatgaatataggcatatccgtatccgaattatccgtttgacagctagcaacgattgtacaattgcttctttaaaaaaggaagaaagaaagaaagaaaagaatcaacatcagcgttaacaaacggccccgttacggcccaaacggtcatatagagtaacggcgttaagcgttgaaagactcctatcgaaatacgtaaccgcaaacgtgtcatagtcagatcccctcttccttcaccgcctcaaacacaaaaataatcttctacagcctatatatacaacccccccttctatctctcctttctcacaattcatcatctttctttctctacccccaattttaagaaatcctctcttctcctcttcattttcaaggtaaatctctctctctctctctctctctgttattccttgttttaattaggtatgtattattgctagtttgttaatctgcttatcttatgtatgccttatgtgaatatctttatcttgttcatctcatccgtttagaagctataaatttgttgatttgactgtgtatctacacgtggttatgtttatatctaatcagatatgaatttcttcatattgttgcgtttgtgtgtaccaatccgaaatcgttgatttttttcatttaatcgtgtagctaattgtacgtatacatatggatctacgtatcaattgttcatctgtttgtgtttgtatgtatacagatctgaaaacatcacttctctcatctgattgtgttgttacatacatagatatagatctgttatatcattttttttattaattgtgtatatatatatgtgcatagatctggattacatgattgtgattatttacatgattttgttatttacgtatgtatatatgtagatctggactttttggagttgttgacttgattgtatttgtgtgtgtatatgtgtgttctgatcttgatatgttatgtatgtgcagcgaattcggcgcgccatggataagaagtactctatcggactcgatatcggaactaactctgtgggatgggctgtgatcaccgatgagtacaaggtgccatctaagaagttcaaggttctcggaaacaccgataggcactctatcaagaaaaaccttatcggtgctctcctcttcgattctggtgaaactgctgaggctaccagactcaagagaaccgctagaagaaggtacaccagaagaaagaacaggatctgctacctccaagagatcttctctaacgagatggctaaagtggatgattcattcttccacaggctcgaagagtcattcctcgtggaagaagataagaagcacgagaggcaccctatcttcggaaacatcgttgatgaggtggcataccacgagaagtaccctactatctaccacctcagaaagaagctcgttgattctactgataaggctgatctcaggctcatctacctcgctctcgctcacatgatcaagttcagaggacacttcctcatcgagggtgatctcaaccctgataactctgatgtggataagttgttcatccagctcgtgcagacctacaaccagcttttcgaagagaaccctatcaacgcttcaggtgtggatgctaaggctatcctctctgctaggctctctaagtcaagaaggcttgagaacctcattgctcagctccctggtgagaagaagaacggacttttcggaaacttgatcgctctctctctcggactcacccctaacttcaagtctaacttcgatctcgctgaggatgcaaagctccagctctcaaaggatacctacgatgatgatctcgataacctcctcgctcagatcggagatcagtacgctgatttgttcctcgctgctaagaacctctctgatgctatcctcctcagtgatatcctcagagtgaacaccgagatcaccaaggctccactctcagcttctatgatcaagagatacgatgagcaccaccaggatctcacacttctcaaggctcttgttagacagcagctcccagagaagtacaaagagattttcttcgatcagtctaagaacggatacgctggttacatcgatggtggtgcatctcaagaagagttctacaagttcatcaagcctatcctcgagaagatggatggaaccgaggaactcctcgtgaagctcaatagagaggatcttctcagaaagcagaggaccttcgataacggatctatccctcatcagatccacctcggagagttgcacgctatccttagaaggcaagaggatttctacccattcctcaaggataacagggaaaagattgagaagattctcaccttcagaatcccttactacgtgggacctctcgctagaggaaactcaagattcgcttggatgaccagaaagtctgaggaaaccatcaccccttggaacttcgaagaggtggtggataagggtgctagtgctcagtctttcatcgagaggatgaccaacttcgataagaaccttccaaacgagaaggtgctccctaagcactctttgctctacgagtacttcaccgtgtacaacgagttgaccaaggttaagtacgtgaccgagggaatgaggaagcctgcttttttgtcaggtgagcaaaagaaggctatcgttgatctcttgttcaagaccaacagaaaggtgaccgtgaagcagctcaaagaggattacttcaagaaaatcgagtgcttcgattcagttgagatttctggtgttgaggataggttcaacgcatctctcggaacctaccacgatctcctcaagatcattaaggataaggatttcttggataacgaggaaaacgaggatatcttggaggatatcgttcttaccctcaccctctttgaagatagagagatgattgaagaaaggctcaagacctacgctcatctcttcgatgataaggtgatgaagcagttgaagagaagaagatacactggttggggaaggctctcaagaaagctcattaacggaatcagggataagcagtctggaaagacaatccttgatttcctcaagtctgatggattcgctaacagaaacttcatgcagctcatccacgatgattctctcacctttaaagaggatatccagaaggctcaggtttcaggacagggtgatagtctccatgagcatatcgctaacctcgctggatctcctgcaatcaagaagggaatcctccagactgtgaaggttgtggatgagttggtgaaggtgatgggaaggcataagcctgagaacatcgtgatcgaaatggctagagagaaccagaccactcagaagggacagaagaactctagggaaaggatgaagaggatcgaggaaggtatcaaagagcttggatctcagatcctcaaagagcaccctgttgagaacactcagctccagaatgagaagctctacctctactacctccagaacggaagggatatgtatgtggatcaagagttggatatcaacaggctctctgattacgatgttgatcatatcgtgccacagtcattcttgaaggatgattctatcgataacaaggtgctcaccaggtctgataagaacaggggtaagagtgataacgtgccaagtgaagaggttgtgaagaaaatgaagaactattggaggcagctcctcaacgctaagctcatcactcagagaaagttcgataacttgactaaggctgagaggggaggactctctgaattggataaggcaggattcatcaagaggcagcttgtggaaaccaggcagatcactaagcacgttgcacagatcctcgattctaggatgaacaccaagtacgatgagaacgataagttgatcagggaagtgaaggttatcaccctcaagtcaaagctcgtgtctgatttcagaaaggatttccaattctacaaggtgagggaaatcaacaactaccaccacgctcacgatgcttaccttaacgctgttgttggaaccgctctcatcaagaagtatcctaagctcgagtcagagttcgtgtacggtgattacaaggtgtacgatgtgaggaagatgatcgctaagtctgagcaagagatcggaaaggctaccgctaagtatttcttctactctaacatcatgaatttcttcaagaccgagattaccctcgctaacggtgagatcagaaagaggccactcatcgagacaaacggtgaaacaggtgagatcgtgtgggataagggaagggatttcgctaccgttagaaaggtgctctctatgccacaggtgaacatcgttaagaaaaccgaggtgcagaccggtggattctctaaagagtctatcctccctaagaggaactctgataagctcattgctaggaagaaggattgggaccctaagaaatacggtggtttcgattctcctaccgtggcttactctgttctcgttgtggctaaggttgagaagggaaagagtaagaagctcaagtctgttaaggaacttctcggaatcactatcatggaaaggtcatctttcgagaagaacccaatcgatttcctcgaggctaagggatacaaagaggttaagaaggatctcatcatcaagctcccaaagtactcactcttcgaactcgagaacggtagaaagaggatgctcgcttctgctggtgagcttcaaaagggaaacgagcttgctctcccatctaagtacgttaactttctttacctcgcttctcactacgagaagttgaagggatctccagaagataacgagcagaagcaacttttcgttgagcagcacaagcactacttggatgagatcatcgagcagatctctgagttctctaaaagggtgatcctcgctgatgcaaacctcgataaggtgttgtctgcttacaacaagcacagagataagcctatcagggaacaggcagagaacatcatccatctcttcacccttaccaacctcggtgctcctgctgctttcaagtacttcgatacaaccatcgataggaagagatacacctctaccaaagaagtgctcgatgctaccctcatccatcagtctatcactggactctacgagactaggatcgatctctcacagctcggtggtgattcaagggctgatcctaagaagaagaggaaggtttgaggcgcgccgagctccaggcctcccagctttcgtccgtatcatcggtttcgacaacgttcgtcaagttcaatgcatcagtttcattgcccacacaccagaatcctactaagtttgagtattatggcattggaaaagctgttttcttctatcatttgttctgcttgtaatttactgtgttctttcagtttttgttttcggacatcaaaatgcaaatggatggataagagttaataaatgatatggtccttttgttcattctcaaattattattatctgttgtttttactttaatgggttgaatttaagtaagaaaggaactaacagtgtgatattaaggtgcaatgttagacatataaaacagtctttcacctctctttggttatgtcttgaattggtttgtttcttcacttatctgtgtaatcaagtttactatgagtctatgatcaagtaattatgcaatcaagttaagtacagtataggcttgagctccctaggctttttttcttcttcttcgttcatacagtttttttttgtttatcagcttacattttcttgaaccgtagctttcgttttcttctttttaactttccattcggagtttttgtatcttgtttcatagtttgtcccaggattagaatgattaggcatcgaaccttcaagaatttgattgaataaaacatcttcattcttaagatatgaagataatcttcaaaaggcccctgggaatctgaaagaagagaagcaggcccatttatatgggaaagaacaatagtatttcttatataggcccatttaagttgaaaacaatcttcaaaagtcccacatcgcttagataagaaaacgaagctgagtttatatacagctagagtcgaagtagtgattggccgttaatttgagagtccagttttagagctagaaatagcaagttaaaataaggctagtccgttatcaacttgaaaaagtggcaccgagtcggtgctttttttctagacccagctttcttgtacaaagttggcattacctaggcccgggcctgaggacgcgtccatggttaattaagacgtccggaccgactagtggatcctctagagtcgacctgcaggcatgcaagcttcttcgtcaacatggtggagcacgacacgcttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcaatcccactatccttcgcaagacccttttaagggggaagttcatttcatttggagaggacacgctgaaatcaccagtctctctgtacaaatcnatctctctctataatattgtgtaagtagttcccagataagggaattagggttcttatagggtttcgctcagctgttgagcatataagaaacccttagtcgatagatctgttggggatctaccatgagcccagaacgacgcccggccgacatccgccgtgccaccgaggcggacatgccggcggtctgcaccatcgtcaaccactacatcgagacaagcacggtcaacttccgtaccgagccgcaggaaccgcaggagtggacggacgacctcgtccgtctgcgggagcgctatccctggctcgtcgccgaggtggacggcgaggtcgccggcatcgcctacgcgggcccctggaaggcacgcaacgcctacgactggacggccgagtcgaccgtgtacgtctccccccgccaccagcggacgggactgggctccacgctctacacccacctgctgaagtccctggaggcacagggcttcaagagcgtggtcgctgtcatcgggctgcccaacgacccgagcgtgcgcatgcacgaggcgctcggatatgccccccgcggcatgctgcgggcggccggcttcaagcacgggaactggcatgacgtgggtttctggcagctggacttcagcctgccggtaccgccccgtccggtcctgcccgtcaccgagatctgatgacccaacttagtatgtatttgtatttgtaaaatacttctatcaataaaatttctaattcctaaaaccaaaatccaggggtaccgaacaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgagcttgagcttggatcagattgtcgtttcccgccttcagtttaaactatcagtgtttgacaggatatattggcgggtaaacctaagagaaaagagcgtttattagaataacggatatttaaaagggcgtgaaaaggtttatccgttcgtccatttgtatgtgcatgccaaccacagggttcccctcgggatcaa

SEQ ID NO: 165 - DNA, 20 bp, artificial sequence
  synthetic construct
gccgttaatttgagagtcca

SEQ ID NO: 166 - DNA, 96 bp, artificial sequence
  synthetic construct
gccgttaatttgagagtccagttttagagctagaaatagcaagttaaaataaggctagtccgttatcaacttgaaaaagtggcaccgagtcggtgc

SEQ ID NO: 167 - DNA, 8 bp, Arabidopsis thaliana
cacgtggc

SEQ ID NO: 168 - DNA, 8 bp, Arabidopsis thaliana
  misc_feature (1)..(1): n is c or t
nacgtggc

SEQ ID NO: 169 - DNA, 8 bp, Arabidopsis thaliana
  misc_feature (1)..(1): n is c, g, or t
  misc_feature (7)..(7): n is g or t
  misc_feature (8)..(8): n is a or c
nacgtgnn

SEQ ID NO: 170 - DNA, 10 bp, Arabidopsis thaliana
gacacgtaga

SEQ ID NO: 171 - DNA, 13 bp, Arabidopsis thaliana
  misc_feature (5)..(10): n is a, c, t, or g
  misc_feature (13)..(13): n is a, c, t, or g
ttccnnnnnnggn

SEQ ID NO: 172 - DNA, 11 bp, Arabidopsis thaliana
ccatttttagt

SEQ ID NO: 173 - DNA, 10 bp, Arabidopsis thaliana
ccatttttgg

SEQ ID NO: 174 - DNA, 18 bp, Arabidopsis thaliana
  misc_feature (1)..(1): n is a, c, t, or g
  misc_feature (4)..(4): n is a, t, or g
  misc_feature (7)..(10): n is a or t
  misc_feature (11)..(12): n is a, c, t, or g
  misc_feature (15)..(15): n is a or t
  misc_feature (18)..(18): n is a, c, t, or g
nttnccnnnnnnggnaan

SEQ ID NO: 175 - DNA, 18 bp, Arabidopsis thaliana
  misc_feature (1)..(2): n is a, c, g, or t
  misc_feature (3)..(3): n is a or t
  misc_feature (4)..(4): n is a, c, g, or t
  misc_feature (8)..(11): n is a or t
  misc_feature (13)..(13): n is a or g
  misc_feature (15)..(16): n is a or t
  misc_feature (18)..(18): n is a, c, g, or t
nnnnccannnntngnnan

SEQ ID NO: 176 - DNA, 16 bp, Arabidopsis thaliana
  misc_feature (3)..(3): n is a or t
  misc_feature (5)..(5): n is c or t
  misc_feature (7)..(10): n is a or t
  misc_feature (12)..(12): n is a or g
  misc_feature (14)..(14): n is a or t
ttncnannnntngnaa

SEQ ID NO: 177 - DNA, 10 bp, Arabidopsis thaliana
ccatttttag

SEQ ID NO: 178 - DNA, 10 bp, Arabidopsis thaliana
ccatttttgg

SEQ ID NO: 179 - DNA, 6 bp, Arabidopsis thaliana
tgtctc

SEQ ID NO: 180 - DNA, 6 bp, Arabidopsis thaliana
tgtctc

SEQ ID NO: 181 - DNA, 9 bp, Arabidopsis thaliana
  misc_feature (5)..(5): n is a or t
caatnattg

SEQ ID NO: 182 - DNA, 9 bp, Arabidopsis thaliana
  misc_feature (5)..(5): n is c or g
caatnattg

SEQ ID NO: 183 - DNA, 9 bp, Arabidopsis thaliana
  misc_feature (5)..(5): n is a, c, t, or g
caatnattg

SEQ ID NO: 184 - DNA, 9 bp, Arabidopsis thaliana
caattatta

SEQ ID NO: 185 - DNA, 7 bp, Arabidopsis thaliana
ctaacca

SEQ ID NO: 186 - DNA, 6 bp, Arabidopsis thaliana
cacatg

SEQ ID NO: 187 - DNA, 6 bp, Arabidopsis thaliana
ggttaa

SEQ ID NO: 188 - DNA, 10 bp, Arabidopsis thaliana
  misc_feature (3)..(8): n is a or t
ccnnnnnngg

SEQ ID NO: 189 - DNA, 18 bp, Arabidopsis thaliana
gtttacataaatggaaaa

SEQ ID NO: 190 - DNA, 18 bp, Arabidopsis thaliana
cttacctttcatggatta

SEQ ID NO: 191 - DNA, 18 bp, Arabidopsis thaliana
ctttccatttttagtaac

SEQ ID NO: 192 - DNA, 8 bp, Arabidopsis thaliana
tggccgac

SEQ ID NO: 193 - DNA, 8 bp, Arabidopsis thaliana
ccacgtgg

SEQ ID NO: 194 - DNA, 8 bp, Arabidopsis thaliana
  misc_feature (3)..(3): n is a or c
aanaatct

SEQ ID NO: 195 - DNA, 10 bp, Arabidopsis thaliana
aaacaatcta

SEQ ID NO: 196 - DNA, 15 bp, Arabidopsis thaliana
aaaaaaaatctatga

SEQ ID NO: 197 - DNA, 7 bp, Arabidopsis thaliana
  misc_feature (5)..(6): n is a, c, t, or g
acacnng

SEQ ID NO: 198 - DNA, 9 bp, Arabidopsis thaliana
taccgacat

SEQ ID NO: 199 - DNA, 9 bp, Arabidopsis thaliana
taccgacat

SEQ ID NO: 200 - DNA, 9 bp, Arabidopsis thaliana
  misc_feature (1)..(1): n is a, g, or t
  misc_feature (2)..(2): n is a or g
  misc_feature (8)..(8): n is a, c, t, or g
  misc_feature (9)..(9): n is a or t
nnccgacnn

SEQ ID NO: 201 - DNA, 8 bp, Arabidopsis thaliana
tttcccgc

SEQ ID NO: 202 - DNA, 8 bp, Arabidopsis thaliana
tttcccgc

SEQ ID NO: 203 - DNA, 9 bp, Arabidopsis thaliana
tctcccgcc

SEQ ID NO: 204 - DNA, 23 bp, Arabidopsis thaliana
ttcaagggggcatgtatcttgaa

SEQ ID NO: 205 - DNA, 23 bp, Arabidopsis thaliana
ttcaagggggcatgtatcttgaa

SEQ ID NO: 206 - DNA, 23 bp, Arabidopsis thaliana
ttcaagggggcatgtatcttgaa

SEQ ID NO: 207 - DNA, 29 bp, Arabidopsis thaliana
ggattcaagggggcatgtatcttgaatcc

SEQ ID NO: 208 - DNA, 11 bp, Arabidopsis thaliana
taagagccgcc

SEQ ID NO: 209 - DNA, 6 bp, Arabidopsis thaliana
gccgcc

SEQ ID NO: 210 - DNA, 9 bp, Arabidopsis thaliana
aaaatatct

SEQ ID NO: 211 - DNA, 6 bp, Arabidopsis thaliana
  misc_feature (1)..(1): n is a or t
  misc_feature (6)..(6): n is a or g
ngatan

SEQ ID NO: 212 - DNA, 8 bp, Arabidopsis thaliana
ccacgtgg

SEQ ID NO: 213 - DNA, 6 bp, Arabidopsis thaliana
cacgtg

SEQ ID NO: 214 - DNA, 6 bp, Arabidopsis thaliana
gccgcc

SEQ ID NO: 215 - DNA, 15 bp, Arabidopsis thaliana
tgtgtggttaatatg

SEQ ID NO: 216 - DNA, 6 bp, Arabidopsis thaliana
ccgtcg

SEQ ID NO: 217 - DNA, 10 bp, Arabidopsis thaliana
  misc_feature (5)..(6): n is a, c, t, or g
agaannttct

SEQ ID NO: 218 - DNA, 6 bp, Arabidopsis thaliana
gataag

SEQ ID NO: 219 - DNA, 10 bp, Arabidopsis thaliana
cgtcaatgaa

SEQ ID NO: 220 - DNA, 13 bp, Arabidopsis thaliana
catacgtcgtcaa

SEQ ID NO: 221 - DNA, 8 bp, Arabidopsis thaliana
  misc_feature (7)..(7): n is c or t
taaatgna

SEQ ID NO: 222 - DNA, 10 bp, Arabidopsis thaliana
acgtcataga

SEQ ID NO: 223 - DNA, 10 bp, Arabidopsis thaliana
tctacgtcac

SEQ ID NO: 224 - DNA, 7 bp, Arabidopsis thaliana
accgaca

SEQ ID NO: 225 - DNA, 12 bp, Arabidopsis thaliana
tctaacctacca

SEQ ID NO: 226 - DNA, 8 bp, Arabidopsis thaliana
  misc_feature (1)..(1): n is a or c
  misc_feature (5)..(5): n is a or t
  misc_feature (7)..(7): n is a or c
naccnanc

SEQ ID NO: 227 - DNA, 8 bp, Arabidopsis thaliana
  misc_feature (1)..(1): n is a or c
  misc_feature (5)..(5): n is a or t
ntccnacc

SEQ ID NO: 228 - DNA, 9 bp, Arabidopsis thaliana
  misc_feature (6)..(6): n is g or c
taactngtt

SEQ ID NO: 229 - DNA, 8 bp, Arabidopsis thaliana
taactaac

SEQ ID NO: 230 - DNA, 7 bp, Arabidopsis thaliana
  misc_feature (2)..(2): n is a or c
  misc_feature (4)..(4): n is a or t
  misc_feature (6)..(6): n is a or c
ancnanc

SEQ ID NO: 231 - DNA, 9 bp, Arabidopsis thaliana
agatcgacg

SEQ ID NO: 232 - DNA, 26 bp, Arabidopsis thaliana
atcttatgtcattgatgacgacctcc

SEQ ID NO: 233 - DNA, 11 bp, Arabidopsis thaliana
tacacttttgg

SEQ ID NO: 234 - DNA, 20 bp, Arabidopsis thaliana
  misc_feature (6)..(6): n is c or t
  misc_feature (10)..(10): n is c or g
  misc_feature (11)..(11): n is a or g
  misc_feature (12)..(12): n is a or c
  misc_feature (14)..(14): n is g or t
  misc_feature (18)..(18): n is c or t
  misc_feature (19)..(20): n is a or c
tgacgnaagnnntnacgnnn

SEQ ID NO: 235 - DNA, 8 bp, Arabidopsis thaliana
cgcggatc

SEQ ID NO: 236 - DNA, 8 bp, Arabidopsis thaliana
gtgatcac

SEQ ID NO: 237 - DNA, 20 bp, Arabidopsis thaliana
ttggttttgatcaaaaccaa

SEQ ID NO: 238 - DNA, 15 bp, Arabidopsis thaliana
taattgactcaatta

SEQ ID NO: 239 - DNA, 5 bp, Arabidopsis thaliana
caaca

SEQ ID NO: 240 - DNA, 6 bp, Arabidopsis thaliana
cacctg

SEQ ID NO: 241 - DNA, 8 bp, Arabidopsis thaliana
catgcatg

SEQ ID NO: 242 - DNA, 9 bp, Arabidopsis thaliana
  misc_feature (2)..(2): n is a, c, g, or t
tncgtacaa

SEQ ID NO: 243 - DNA, 6 bp, Arabidopsis thaliana
actttg

SEQ ID NO: 244 - DNA, 16 bp, Arabidopsis thaliana
aggggcataatggtaa

SEQ ID NO: 245 - DNA, 9 bp, Arabidopsis thaliana
aaaccctaa

SEQ ID NO: 246 - DNA, 8 bp, Arabidopsis thaliana
tgacgtgg

SEQ ID NO: 247 - DNA, 5 bp, Arabidopsis thaliana
ttgac

SEQ ID NO: 248 - DNA, 8 bp, Arabidopsis thaliana
atacgtgt

SEQ ID NO: 249 - DNA, 16 bp, Arabidopsis thaliana
aaaacagaataggaaa

SEQ ID NO: 250 - DNA, 8 bp, Arabidopsis thaliana
aaattaaa

SEQ ID NO: 251 - DNA, 8 bp, Arabidopsis thaliana
aaattagt

SEQ ID NO: 252 - DNA, 8 bp, Arabidopsis thaliana
actaattt

SEQ ID NO: 253 - DNA, 12 bp, Arabidopsis thaliana
ccaatttaatgg

SEQ ID NO: 254 - DNA, 6 bp, Arabidopsis thaliana
actcat

SEQ ID NO: 255 - DNA, 19 bp, Arabidopsis thaliana
cttaaaccctaggggtaat

SEQ ID NO: 256 - DNA, 10 bp, Arabidopsis thaliana
  misc_feature (3)..(3): n is a or t
ttntactagt

SEQ ID NO: 257 - DNA, 9 bp, Arabidopsis thaliana
ataaaacgt

SEQ ID NO: 258 - DNA, 9 bp, Arabidopsis thaliana
tgtatatat

SEQ ID NO: 259 - DNA, 9 bp, Arabidopsis thaliana
ctcctaatt

SEQ ID NO: 260 - DNA, 10 bp, Arabidopsis thaliana
ttgcatgact

SEQ ID NO: 261 - DNA, 6 bp, Arabidopsis thaliana
agccac

SEQ ID NO: 262 - DNA, 5 bp, Arabidopsis thaliana
gggcc

SEQ ID NO: 263 - DNA, 9 bp, Arabidopsis thaliana
ctcaagtga

SEQ ID NO: 264 - DNA, 9 bp, Arabidopsis thaliana
gtatgatgg

SEQ ID NO: 265 - DNA, 7 bp, Arabidopsis thaliana
gagtgag

SEQ ID NO: 266 - DNA, 8 bp, Arabidopsis thaliana
cacgtggc

SEQ ID NO: 267 - DNA, 34 bp, artificial sequence
  synthetic construct
gtttaattgagttgtcatatgttaataacggtat

SEQ ID NO: 268 - DNA, 34 bp, artificial sequence
  synthetic construct
ataccgttattaacatatgacaactcaattaaac

SEQ ID NO: 269 - DNA, 97 bp, Zea mays
tggaggtgcgcgtcaagatcctcttcacctcgctctgccacaccgacgtctacttctgggaggccaaggtatctaatcagccatcccatttgtgatc

SEQ ID NO: 270 - DNA, 97 bp, artificial sequence; identical to SEQ ID NO: 269
  synthetic construct

SEQ ID NO: 271 - DNA, 131 bp, artificial sequence
  synthetic construct
tggaggtgcgcgtcaagatcctcttcacctcgctctgccacaccgacgataccgttattaacatatgacaactcaattaaactctacttctgggaggccaaggtatctaatcagccatcccatttgtgatc

SEQ ID NO: 272 - DNA, 98 bp, artificial sequence
  synthetic construct
tggaggtgcgcgtcaagatcctcttcacctcgctctgccacaccgacgttctacttctgggaggccaaggtatctaatcagccatcccatttgtgatc

SEQ ID NO: 273 - DNA, 159 bp, artificial sequence
  synthetic construct
  misc_feature (46)..(50): n is a, c, t, or g
tggaggtgcgcgtcaagatcctcttcacctcgctctgccacaccgnnnnngagttgtcatatgttaataacggtatgtttaattgagttgtcatatgttaataacggtattctacttctgggaggccaaggtatctaatcagccatcccatttgtgatc

SEQ ID NO: 274 - DNA, 129 bp, artificial sequence
  synthetic construct
tggaggtgcgcgtcaagatcctcttcacctcgctctgccacaccgacgtttaattgagttgtcatatgttaataacggtatctacttctgggaggccaaggtatctaatcagccatcccatttgtgatc

SEQ ID NO: 275 - DNA, 97 bp, artificial sequence; identical to SEQ ID NO: 269
  synthetic construct

SEQ ID NO: 276 - DNA, 129 bp, artificial sequence
  synthetic construct
tggaggtgcgcgtcaagatcctcttcacctcgctctgccacaccgacgataccgttattaacatatgacaactcaattaaactacttctgggaggccaaggtatctaatcagccatcccatttgtgatc

SEQ ID NO: 277 - DNA, 159 bp, artificial sequence
  synthetic construct
  misc_feature (46)..(50): n is a, c, t, or g
tggaggtgcgcgtcaagatcctcttcacctcgctctgccacaccgnnnnntgagttgtcatatgttaataacggtatgttaattgagttgtcatatgttaataacggtattctacttctgggaggccaaggtatctaatcagccatcccatttgtgatc

SEQ ID NO: 278 - DNA, 92 bp, artificial sequence
  synthetic construct
tggaggtgcgcgtcaagatcctcttcacctcgctctgccacaccgacgttctgggaggccaaggtatctaatcagccatcccatttgtgatc

SEQ ID NO: 279 - DNA, 159 bp, artificial sequence
  synthetic construct
  misc_feature (46)..(50): n is a, c, t, or g
tggaggtgcgcgtcaagatcctcttcacctcgctctgccacaccgnnnnntattaacatatgacaactcaattaaactaccgttattaacatatgacaactcaattaaactctacttctgggaggccaaggtatctaatcagccatcccatttgtgatc

SEQ ID NO: 280 - DNA, 159 bp, artificial sequence
  synthetic construct
  misc_feature (46)..(50): n is a, c, t, or g
tggaggtgcgcgtcaagatcctcttcacctcgctctgccacaccgnnnnngtttaattgagttgtcatatgttaataacggtattaccgttattaacatatgacaactcaattaaacctgggaggccaaggtatctaatcagccatcccatttgtgatc

SEQ ID NO: 281 - DNA, 159 bp, artificial sequence
  synthetic construct
  misc_feature (46)..(50): n is a, c, t, or g
tggaggtgcgcgtcaagatcctcttcacctcgctctgccacaccgnnnnnggtttaattgagttgtcatatgttaataacggtagtttaattgagttgtcatatgttaataacggtattgggaggccaaggtatctaatcagccatcccatttgtgatc

SEQ ID NO: 282 - DNA, 91 bp, artificial sequence
  synthetic construct
tggaggtgcgcgtcaagatcctcttcacctcgctctgccacaccgacttctgggaggccaaggtatctaatcagccatcccatttgtgatc

SEQ ID NO: 283 - DNA, 94 bp, artificial sequence
  synthetic construct
tggaggtgcgcgtcaagatcctcttcacctcgctctgccacaccgacgacttctgggaggccaaggtatctaatcagccatcccatttgtgatc

SEQ ID NO: 284 - DNA, 98 bp, artificial sequence
  synthetic construct
tggaggtgcgcgtcaagatcctcttcacctcgctctgccacaccgacgctctacttctgggaggccaaggtatctaatcagccatcccatttgtgatc

SEQ ID NO: 285 - DNA, 159 bp, artificial sequence
  synthetic construct
  misc_feature (46)..(50): n is a, c, t, or g
tggaggtgcgcgtcaagatcctcttcacctcgctctgccacaccgnnnnngagttgtcatatgttaataacggtatataccgttattaacatatgacaactcaattaaactctacttctgggaggccaaggtatctaatcagccatcccatttgtgatc

SEQ ID NO: 286 - DNA, 159 bp, artificial sequence
  synthetic construct
  misc_feature (46)..(50): n is a, c, t, or g
tggaggtgcgcgtcaagatcctcttcacctcgctctgccacaccgnnnnnttgagttgtcatatgttaataacggtataccgttattaacatatgacaactcaattaaactctacttctgggaggccaaggtatctaatcagccatcccatttgtgatc

SEQ ID NO: 287 - DNA, 159 bp, artificial sequence
  synthetic construct
  misc_feature (46)..(50): n is a, c, t, or g
tggaggtgcgcgtcaagatcctcttcacctcgctctgccacaccgnnnnnttaattgagttgtcatatgttaataacggtataccgttattaacatatgacaactcaattaaaccttctgggaggccaaggtatctaatcagccatcccatttgtgatc

SEQ ID NO: 288 - DNA, 96 bp, artificial sequence
  synthetic construct
tggaggtgcgcgtcaagatcctcttcacctcgctctgccacaccgactctacttctgggaggccaaggtatctaatcagccatcccatttgtgatc

SEQ ID NO: 289 - DNA, 127 bp, artificial sequence
  synthetic construct
tggaggtgcgcgtcaagatcctcttcacctcgctctgccacaccgacggtttaattgagttgtcatatgttaataacggtatcttctgggaggccaaggtatctaatcagccatcccatttgtgatc

SEQ ID NO: 290 - DNA, 126 bp, artificial sequence
  synthetic construct
tggaggtgcgcgtcaagatcctcttcacctcgctctgccacaccgacgataccgttattaacatatgacaactcaattaaacttctgggaggccaaggtatctaattagccatcccatttgtgatc

SEQ ID NO: 291 - DNA, 125 bp, artificial sequence
  synthetic construct
tggaggtgcgcgtcaagatcctcttcacctcgctctgccacaccgacggtttaattgagttgtcatatgttaataacggtattctgggaggccaaggtatctaatcagccatcccatttgtgatc

SEQ ID NO: 292 - DNA, 128 bp, artificial sequence
  synthetic construct
tggaggtgcgcgtcaagatcctcttcacctcgctctgccacaccgataccgttattaacatatgacaactcaattaaactctacttctgggaggccaaggtatctaatcagccatcccatttgtgatc

SEQ ID NO: 293 - DNA, 110 bp, artificial sequence
  synthetic construct
tggaggtgcgcgtcaagatcctcttcacctaccgttattaacatatgacaactcaattaaacctacttctgggaggccaaggtatctaatcagccatcccatttgtgatc

SEQ ID NO: 294 - DNA, 88 bp, artificial sequence
  synthetic construct
tggaggtgcgcgtcaagatcctcttcacctcgctctgccacaccgacggggaggccaaggtatctaatcagccatcccatttgtgatc

SEQ ID NO: 295 - DNA, 104 bp, artificial sequence
  synthetic construct
tggaggtgcgcgtcaagatcctcttcacctcgctctgccacaccgacggtttaattctacttctgggaggccaaggtatctaatcagccatcccatttgtgatc

SEQ ID NO: 296 - DNA, 159 bp, artificial sequence
  synthetic construct
  misc_feature (46)..(50): n is a, c, t, or g
tggaggtgcgcgtcaagatcctcttcacctcgctctgccacaccgnnnnnccgttattaacatatgacaactcaattataccgttattaacatatgacaactcaattaaacctacttctgggaggccaaggtatctaatcagccatcccatttgtgatc

SEQ ID NO: 297 - DNA, 130 bp, artificial sequence
  synthetic construct
tggaggtgcgcgtcaagatcctcttcacctcgctctgccacaccgacggtttaattgagttgtcatatgttaataacggtatctacttctgggaggccaaggtatctaatcagccatcccatttgtgatc

SEQ ID NO: 298 - DNA, 94 bp, artificial sequence
  synthetic construct
tggaggtgcgcgtcaagatcctcttcacctcgctctgccacaccgactacttctgggaggccaaggtatctaatcagccatcccatttgtgatc

SEQ ID NO: 299 - DNA, 131 bp, artificial sequence; identical to SEQ ID NO: 271
  synthetic construct

SEQ ID NO: 300 - DNA, 93 bp, artificial sequence
  synthetic construct
tggaggtgcgcgtcaagatcctcttcacctcgctctgccacaccgacacttctgggaggccaaggtatctaatcagccatcccatttgtgatc

SEQ ID NO: 301 - DNA, 131 bp, artificial sequence
  synthetic construct
tggaggtgcgcgtcaagatcctcttcacctcgctctgccacaccgacggtttaattgagttgtcatatgttaataacggtattctacttctgggaggccaaggtatctaatcagccatcccatttgtgatc

SEQ ID NO: 302 - DNA, 159 bp, artificial sequence
  synthetic construct
  misc_feature (46)..(50): n is a, c, t, or g
tggaggtgcgcgtcaagatcctcttcacctcgctctgccacaccgnnnnnagttgtcatatgttaataacggtatataccgttattaacatatgacaactcaattaaacatctacttctgggaggccaaggtatctaatcagccatcccatttgtgatc

SEQ ID NO: 303 - DNA, 159 bp, artificial sequence
  synthetic construct
  misc_feature (46)..(50): n is a, c, t, or g
tggaggtgcgcgtcaagatcctcttcacctcgctctgccacaccgnnnnntataatcctcatgtcagccatggagtatttggaaatacagaaattcatggttggtggacatctacttctgggaggccaaggtatctaatcagccatcccatttgtgatc

SEQ ID NO: 304 - DNA, 96 bp, artificial sequence
  synthetic construct
tggaggtgcgcgtcaagatcctcttcacctcgctctgccacaccgacgctacttctgggaggccaaggtatctaatcagccatcccatttgtgatc

SEQ ID NO: 305 - DNA, 497 bp, Zea mays
gggttgttgtgggttgaacccgtcccaaccatcatcaactcgctagccaaacacacgcttaggggccaaagcagtgctataatatgagtggtggcgctattatatatagcgtcagagaacttagatctgatattctgatgaagaaaaaatgactttactgactacgaaagaagaagaaaggagctatagagagagagaaaaagaggggtcgtgtagtgcttaaactgtacatgaacagcagtagtgttacagaagctaaactcaaccagagctccaccaaagacaaagagggtctacttccatcaccgtcttgctcggtcacttggagctctgtccataaattaaacccatcttggatcccaaggttcgtggcatatctgtaggcatctaccccgtcttcgtcgtccgctcctcactagctaccaagaggtcgccattattgccaacatagagtgtacgtggatgtctatatatatgcctacttgcacccatatggc

SEQ ID NO: 306 - DNA, 34 bp, artificial sequence
  synthetic construct
ccgacaaaaggccgacaaaaggccgacaaaaggt

SEQ ID NO: 307 - DNA, 34 bp, artificial sequence
  synthetic construct
accttttgtcggccttttgtcggccttttgtcgg

SEQ ID NO: 308 - DNA, 11 bp, artificial sequence
  synthetic construct
ccttttgtcgg

SEQ ID NO: 309 - DNA, 68 bp, artificial sequence
  synthetic construct
gccgacaaaaggccgacaaaaggccgacaaaaggccgacaaaaggccgacaaaaggccgacaaaaggt

SEQ ID NO: 310 - DNA, 68 bp, artificial sequence
  synthetic construct
accttttgtcggccttttgtcggccttttgtcggccttttgtcggccttttgtcggccttttgtcggc

SEQ ID NO: 311 - DNA, 100 bp, artificial sequence
  synthetic construct
ccgacaaaaggccgacaaaaggccgacaaaaggccgacaaaaggccgacaaaaggccgacaaaaggccgacaaaaggccgacaaaaggccgacaaaaggt

SEQ ID NO: 312 - DNA, 100 bp, artificial sequence
  synthetic construct
accttttgtcggccttttgtcggccttttgtcggccttttgtcggccttttgtcggccttttgtcggccttttgtcggccttttgtcggccttttgtcgg

SEQ ID NO: 313 - DNA, 21 bp, artificial sequence
  synthetic construct
ctccaccaaagacaaagaggg

SEQ ID NO: 314 - DNA, 21 bp, artificial sequence
  synthetic construct
gccatatgggtgcaagtaggc

SEQ ID NO: 315 - DNA, 226 bp, artificial sequence
  synthetic construct
ctccaccaaagacaaagagggtctacttccatcaccgtcttgctcggtcacttggagctctgtccataaattaaacccatcttggatcccaaggttcgtggcatatctgtaggcatctaccccgtcttcgtcgtccgctcctcactagctaccaagaggtcgccattattgccaacatagagtgtacgtggatgtctatatatatgcctacttgcacccatatggc

SEQ ID NO: 316 - DNA, 34 bp, artificial sequence
  synthetic construct
ataacttcgtatagcatacattatacgaagttat

SEQ ID NO: 317 - DNA, 34 bp, artificial sequence
  synthetic construct
ataacttcgtataatgtatgctatacgaagttat

SEQ ID NO: 318 - DNA, 34 bp, artificial sequence
  synthetic construct
  misc_feature (14)..(16): n is a, c, t, or g
  misc_feature (19)..(21): n is a, c, t, or g
ataacttcgtatannntannntatacgaagttat

SEQ ID NO: 319 - DNA, 34 bp, artificial sequence
  synthetic construct
ataacttcgtataatgtatactatacgaagttat

SEQ ID NO: 320 - DNA, 34 bp, artificial sequence
  synthetic construct
ataacttcgtataatgtgtactatacgaagttat

SEQ ID NO: 321 - DNA, 34 bp, artificial sequence
  synthetic construct
ataacttcgtataaagtatcctatacgaagttat

SEQ ID NO: 322 - DNA, 34 bp, artificial sequence
  synthetic construct
ataacttcgtataagaaaccatatacgaagttat

SEQ ID NO: 323 - DNA, 34 bp, artificial sequence
  synthetic construct
ataacttcgtatataataccatatacgaagttat

SEQ ID NO: 324 - DNA, 34 bp, artificial sequence
  synthetic construct
ataacttcgtataagatagaatatacgaagttat

SEQ ID NO: 325 - DNA, 34 bp, artificial sequence; identical to SEQ ID NO: 324
  synthetic construct

SEQ ID NO: 326 - DNA, 34 bp, artificial sequence
  synthetic construct
  misc_feature (14)..(16): n is a, c, t, or g
  misc_feature (19)..(21): n is a, c, t, or g
taccgttcgtatannntannntatacgaagttat

SEQ ID NO: 327 - DNA, 34 bp, artificial sequence
  synthetic construct
  misc_feature (14)..(16): n is a, c, t, or g
  misc_feature (19)..(21): n is a, c, t, or g
ataacttcgtatannntannntatacgaacggta

SEQ ID NO: 328 - DNA, 11 bp, artificial sequence
  synthetic construct
cctcgtgtctc

SEQ ID NO: 329 - DNA, 11 bp, artificial sequence
  synthetic construct
ccttttgtctc

SEQ ID NO: 330 - DNA, 11 bp, artificial sequence
  synthetic construct
  misc_feature (10)..(10): n is a, c, or g
ccttttgtcnc

SEQ ID NO: 331 - DNA, 6 bp, artificial sequence
  synthetic construct
tgtctc

SEQ ID NO: 332 - protein, 5 aa, artificial sequence
  synthetic construct
  MISC_FEATURE (2)..(2): X is any amino acid
  MISC_FEATURE (4)..(4): X is any amino acid
LXLXL

SEQ ID NO: 333 - protein, 6 aa, artificial sequence
  synthetic construct
  MISC_FEATURE (4)..(5): X is any amino acid
DLNXXP

SEQ ID NO: 334 - RNA, 36 nt, artificial sequence
  synthetic construct
cuccaagugaccgagcaagaguuuuagagcuaugcu

SEQ ID NO: 335 - DNA, 392 bp, Zea mays
acaacaaaaaaaggtaacctcgctactaacataacaaaatacttgttgcttattaattatatgttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggattctaaagaggaagtgcagctcttcttggggaatgctggaactgcaatgcggccattgacagcagctgttactgctgctggtggaaatgcaacgtatgtttcctctctttctctctacaatacttgctggagttagtatgaaacccatgggtatgtctagt

SEQ ID NO: 336 - RNA, 36 nt, artificial sequence
  Synthetic construct
auuuuguuauguuaguagcgguuuuagagcuaugcu

SEQ ID NO: 337 - RNA, 36 nt, artificial sequence
  Synthetic construct
ggaguuaguaugaaacccauguuuuagagcuaugcu

SEQ ID NO: 338 - DNA, 23 bp, artificial sequence
  Synthetic construct
tactaacataacaaaatacttgt

SEQ ID NO: 339 - DNA, 23 bp, artificial sequence
  Synthetic construct
ggtttcatactaactccagcaag

SEQ ID NO: 340 - DNA, 353 bp, artificial sequence
  Synthetic construct
tactaacataacaaaatacttgttgcttattaattatatgttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggattctaaagaggaagtgcagctcttcttggggaatgctggaattgcaatgcgggcattgacagcagctgttactgctgctggtggaaatgcaacgtatgtttcctctctttctctctacaatacttgctggagttagtatgaaacc

SEQ ID NO: 341 - DNA, 16 bp, Agrobacterium tumefasciens
acgtaagcgcttacgt

SEQ ID NO: 342 - DNA, 15 bp, Zea mays
acgtaagcgcttacg

SEQ ID NO: 343 - DNA, 12 bp, Zea mays
gtaagcgcttac

SEQ ID NO: 344 - RNA, 36 nt, artificial sequence
  Synthetic construct
auagagagagagaaaaagagguuuuagagcuaugcu

SEQ ID NO: 345 - DNA, 672 bp, Zea mays
cgataaacgccactaaaaatggttttacgaccgccagtatatatcttctctgtactagtgtgatactatcaggccgcatgcagattcctttcgattgtttatagggtttttttttttataaagactgctggttttcaagccttgaatcttgtagctaggtagccagaccggtcccggccgggtcgaggaagacgcaaaactcagcaagcacagttgtgctagcctgctaggcacggtgtgtagcaagagacagaaacgagcgtataaccatggcgattaactgatagctgtggaattttgagcacatagtcctccaaacatttgcatttgtattgtactattgtttatgtagcgaagtttaaaatgcagtttggtaggcctaacccgcatgcgagggcaccgcacagtgaggctgaggaacggaaccactccagctaagattccgcaccgcagcaaccctgggatcctgctgtcagcgcgggccgcgggaggggagattcactggcagcagggccccacaccccttcccaggcttcccatctcagaaaacagaagccgatctgttttgttctgccgaatcaaaagtgcgatatgatcgtcatctcttcgacagcacccgcccaaccatctcctataaatccgatcgccgccactggccgttcgtcccccatc

SEQ ID NO: 346 - RNA, 36 nt, artificial sequence
  Synthetic construct
ccagugaaucuccccucccgguuuuagagcuaugcu

SEQ ID NO: 347 - RNA, 36 nt, artificial sequence
  Synthetic construct
cguuccucagccucacugugguuuuagagcuaugcu

SEQ ID NO: 348 - RNA, 36 nt, artificial sequence
  Synthetic construct
cagaaacgagcguauaaccaguuuuagagcuaugcu

SEQ ID NO: 349 - DNA, 43 bp, artificial sequence
  Synthetic construct
aagagatgagctcttgagcaatgtaaagggtcaagttgtttct

SEQ ID NO: 350 - DNA, 43 bp, artificial sequence
  Synthetic construct
agaaacaacttgaccctttacattgctcaagagctcatctctt

SEQ ID NO: 351 - RNA, 34 nt, artificial sequence
  synthetic construct
accuuuugucggccuuuugucggccuuuugucgg

SEQ ID NO: 352 - RNA, 21 nt, artificial sequence
  synthetic construct
uggacagagcuccaagugacc

SEQ ID NO: 353 - DNA, 38 bp, artificial sequence
  synthetic construct
tcggtccgacaaaaggccgacaaaaggcggacaaaagg

SEQ ID NO: 354 - DNA, 38 bp, artificial sequence
  synthetic construct
accgaccttttgtcggccttttgtcggccttttgtcgg

SEQ ID NO: 355 - DNA, 346 bp, Oryza sativa
aagcggaggtccggaggaggaagcggcgagagaagctcagctaggcagggcgacgggcagaaacgcgaccacggcaacaaaccccgccgcgcgcgcccaccgtgccggttacatgggagtagaggcgggcggcggctgcggtgggagggcggtagtcaccggattctacgtctggggctgggagttcctcaccgccctcctgctcttctcggccaccacctcctactagctatacacacccatctcaccataacacacatacatagatagatagatagatagatacatacacacaaacataagtagctaggtagagaaagagatcatagcgttaggtgatcgatcg

SEQ ID NO: 356 - DNA, 117 bp, Oryza sativa
atgggagtagaggcgggcggcggctgcggtgggagggcggtagtcaccggattctacgtctggggctgggagttcctcaccgccctcctgctcttctcggccaccacctcctactag

SEQ ID NO: 357 - DNA, 89 bp, Oryza sativa
gaggcctcctcctcgcctcgcctcgccacgccgcgccgcgacgcgacgcgccgtggtcagctggtcgccggtgcgggtgcgggtgcgca

SEQ ID NO: 358 - DNA, 15 bp, artificial sequence
  synthetic construct
aaaaaaaaaaaaaaa

SEQ ID NO: 359 - DNA, 25 bp, Arabidopsis thaliana
cacatacacacaaaaataaaaaaga

SEQ ID NO: 360 - DNA, 325 bp, Oryza sativa
caaacgccaaaacgccacggaaacaaatcaacaatttcctctcctgtcaatgaacttgtgtgcacgacaactcatctgacagtgatccatcgtcctttttctttgactcgatgactttgtgagagatgttttatgccgattttatctactaaagtacttactaatcctgcggttgatccatcgccgcgcggttcacgcgccaaatgacgagtcgaaatgtatgcgtagtttgaccacatgcatagctcactggagaagctattagctatatataccgctgcaatgctcgctagcttagctaagcaactgcaagtgaagcggcgac

SEQ ID NO: 361 - RNA, 36 nt, artificial sequence
  synthetic construct
caaacaaaaaagaaugcaugguuuuagagcuaugcu

SEQ ID NO: 362 - RNA, 36 nt, artificial sequence
  synthetic construct
uguauccguauuuauacgugguuuuagagcuaugcu

SEQ ID NO: 363 - RNA, 36 nt, artificial sequence
  synthetic construct
gacgcgagugggggcccacgguuuuagagcuaugcu

SEQ ID NO: 364 - DNA, 16 bp, artificial sequence
  synthetic construct
gaatatatatatattc

SEQ ID NO: 365 - RNA, 36 nt, artificial sequence
  synthetic construct
gcgcuccuucuccuccauggguuuuagagcuaugcu

SEQ ID NO: 366 - RNA, 36 nt, artificial sequence
  synthetic construct
ccucggcguggcgcucucggguuuuagagcuaugcu

SEQ ID NO: 367 - DNA, 550 bp, Zea mays
gtgaacaaccttatgaaatttgggcgcaaagaactcgccctcaagggttgatcttatgccatcgtcatgataaacagtggagcacggacgatcctttacgttgtttttaacaaactttgtcagaaaactagcatcattaacttcttaatgacgatttcacaacaaaaaaaggtaacctcgctactaacataacaaaatacttgttgcttattaattatatgttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggattctaaagaggaagtgcagctcttcttggggaatgctggaactgcaatgcggccattgacagcagctgttactgctgctggtggaaatgcaacgtatgtttcctctctttctctctacaatacttgctggagttagtatgaaacccatgggtatgtctagt

SEQ ID NO: 368 - RNA, 41 nt, artificial sequence
  synthetic construct
uaauuucuacucuuguagauggcgcaaagaacucgcccuca

SEQ ID NO: 369 - RNA, 41 nt, artificial sequence
  synthetic construct
uaauuucuacucuuguagauauacuaacuccagcaaguauu

SEQ ID NO: 370 - DNA, 45 bp, artificial sequence
  synthetic construct
tcaagggtataacttcgtatagcatacattatacgaagttattca

SEQ ID NO: 371 - DNA, 45 bp, artificial sequence
  synthetic construct
cttgatgaataacttcgtataatgtatgctatacgaagttatacc

SEQ ID NO: 372 - DNA, 45 bp, artificial sequence
  synthetic construct
acaatggtataacttcgtataaagtatcctatacgaagttattca

SEQ ID NO: 373 - DNA, 45 bp, artificial sequence
  synthetic construct
attgttgaataacttcgtataggatactttatacgaagttatacc

SEQ ID NO: 374 - DNA, 24 bp, artificial sequence
  synthetic construct
gtgaacaaccttatgaaatttggg

SEQ ID NO: 375 - DNA, 24 bp, artificial sequence
  synthetic construct
actagacatacccatgggtttcat

SEQ ID NO: 376 - DNA, 618 bp, artificial sequence
  synthetic construct
gtgaacaaccttatgaaatttgggcgcataacttcgtatagcatacattatacgaagttataaagaactcgccctcaagggttgatcttatgccatcgtcatgataaacagtggagcacggacgatcctttacgttgtttttaacaaactttgtcagaaaactagcatcattaacttcttaatgacgatttcacaacaaaaaaaggtaacctcgctactaacataacaaaatacttgttgcttattaattatatgttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggattctaaagaggaagtgcagctcttcttggggaatgctggaattgcaatgcgggcattgacagcagctgttactgctgctggtggaaatgcaacgtatgtttcctctctttctctctacaatacttgcataacttcgtataaagtatcctatacgaagttattggagttagtatgaaacccatgggtatgtctagt

SEQ ID NO: 377 - DNA, 92 bp, artificial sequence
  synthetic construct
attaaaaaaataaataagatattattaaaaaaataaataagatattattaaaaaaataaataagatattattaaaaaaataaataagatatt

SEQ ID NO: 378 - DNA, 36 bp, artificial sequence
  synthetic construct
ttatttattttatttattttatttattttatttatt

SEQ ID NO: 379 - DNA, 111 bp, artificial sequence
  synthetic construct
atggaagaaaccaaacgaaactccgatcttctccgttctcgtgttttcctctctggcttttattgctgggattgggaatttctcaccgctctcttgctttttagttgctga

SEQ ID NO: 380 - DNA, 92 bp, artificial sequence
  synthetic construct
agatctaggagactgacatagattggaggagacattttgtataataagatctaggagactgacatagattggaggagacattttgtataata

SEQ ID NO: 381 - DNA, 201 bp, Zea mays
tccatcctcgctctacctgcctgctgccagtttcaactctccaaggtcaacgccagccctcgcgcgcttggtgtactctagtttagtacaccaatccgcatgcattcttttttgtttgtttgtttgtttgtttgttttgattgacaaatatatgcggcagagttaagaacgaatcgactccgtcgtctcggctagtcgacc

SEQ ID NO: 382 - DNA, 201 bp, Zea mays
aggggcttgacgccttaccagtacgcggtgctccctcttctcgcacctaccgcacggaggatatgacctaatacaattaatttacgcggaactcgaaatgtatccgtatttatacgtgtggaacgtacaagtatacgtattttgttggttttttttttactttttacccggctggacgccaaccaactggtttcccgtcct

SEQ ID NO: 383 - DNA, 201 bp, Zea mays
cgggcccacgggaggtcgcgtcgattcgcagcagcgcgccgcccccctccccaccaccacgtcaagcggcgtgggcttccgcccctccctgcccgccgcgtgggcccccactcgcgtcctgtaaccgggatagcgtgagcacgtcgctatcgtccgtaacggcgaccgcgaccataagagaggaggcaaagccagcccccg

SEQ ID NO: 384 - DNA, 201 bp, Zea mays
agcacggacgatcctttacgttgtttttaacaaactttgtcagaaaactagcatcattaacttcttaatgacgatttcacaacaaaaaaaggtaacctcgctactaacataacaaaatacttgttgcttattaattatatgttttttaatctttgatcaggggacaacagtggttgataacctgttgaacagtgaggatgt

SEQ ID NO: 385 - DNA, 201 bp, Zea mays
attccgttggacccctaccgctcctcagtcagtcctcgcccctcccagcaccggccaacaatccctcacgttattccctgtagctactatgctgccctcttggatccctttttcacttgtctgagatttagccaccgcccggtaggaagaagaaggggaagcaccatattttctgttcctggcctgacgcagcgccggtga

SEQ ID NO: 386 - DNA, 280 bp, Zea mays
caagcaagcaggttcagaagaagaacacggagaaacttgaagtaatgctaggtaggttagcacgaagtagtttctgcgcgttctctgtgatcttttggcatttgtttttggctgctggtggcttaccatcgtcagatggtgacggaggaaggagggaacatggatctggatggtgtgagccacagattacattacagtagtagagtaaactatgagagttcttgtggactgaaggtgtgtagtggtggatagggtagcttctccggggttcttttgtgtg

SEQ ID NO: 387 - DNA, 307 bp, Zea mays
gacttctgagcgaggagtggacgagtggtgtgccgtcgtccggttcccgttggtttggcgatgaggcgcgctcgcggtcgccgcgggctgctgcttctcctcggcgtggcgctctcggcggctgcgctgctccgtggctgcgcggggcagcaaggggaggacggctcggacgcccctgcggcggcggcggcggagacggcccccatggaggagaaggagcgcagggcgctgtacgccgccatcgagagcttcgtcggcaaggggtggaacggctccgggctctacccagacccctgcggctggtctc

SEQ ID NO: 388 - DNA, 546 bp, Glycine max
aatttaatctaatggtagataatgtgttcaaaggaacgcttgataacatttctcgtgataaatacgtatttatgagactatttagttatgatcatccatgtcaattaatttccaacccaaagtaatgatcatgtgccaagttgccacccataatttatctcaaaattaatgaaacccaaataaaggcgttgaataataccaccatacaaaagtgtgttatttagcagcatatgtaactaggcatatatctatctgtatatatgagagttgattatgtgtcacatatgaacctttgagacataccatgggttctttttggcatacgcggcgaaatggattacgtcaaatacagcttttgtttaatgcttaaagctttggcagccgatggaaatttcattggcattgtcaacgccttcccctactataagtacaatcacactccttgtctctccctcacaacactaggccttcaatttggttttgtttcatcagttttccagatacagcacattgattgttaaggcgaaatggctgatattgagggtt

SEQ ID NO: 389 - DNA, 474 bp, Glycine max
ttgtttactcctagttattatcttaaaaaaattgaatcatataattatatattaagttttgaatatgtgtttccatcttatagtttatgagattaccatgtgtttaacagattgggatctacaaactttaaaagtaagcagtagatacataatagttttataggcctggttggttagctgaaatttacagctactacgcggataatgaaccccaatgatgaaaacatgcagacgcatgttgcagcatggaagtattttatttaataagaataataataaggtaagtggtagtaattaaattccatattcagtatcatgggaaatgagattctttgcctttgggatacaccattaggcttttagccgttccactgtgtatatgcggcgaaatgcattactccatggcccttgggaatccacttgcctcctatcagactcttacgtagtcaacgccttcgcctactataaaaacac

SEQ ID NO: 390 - DNA, 514 bp, Glycine max
aaagaagctatgaggtgcaagaaccgatcacatggagaaggcaatgaaagacaaggaggagcaatggaagagagaaaatgagaagatggaagggatgtgaaaatgtttgaaaaaaacgaggtgatcagttttaaaatacgaatttagtattttctttttaagaaaattctttcggaaagtcgtgttttaaaacatgacttttatttatttgaagtcgtgttctaaaacatgactttatttcatatcctttaatattttatatccttaatatttttaaaatttatccatttgtaatattttttaaaaattgacccatatatgtaaaatacccgtcaagatctctttattattttgaaagcgaaagcatatcacttcaaacacaatggaatcgaggctattgactaagtataaatagagaagacttcatatcggggttcataattcataacaaagcaaacgagtatataagaaagcataagccaaattttgagtaaactagtgtgcacactatccc

SEQ ID NO: 391 - DNA, 476 bp, Glycine max
cacgtggccccacacacattttttttccctcaacagttaaactctcttcctccatctttcttggtaggtggcacttctcggagcatagtaaaactaaccccacatttttctttttcattttcattttcattatattataaacctatatatatacccaattggttattggtgtctggtgtcccttcaacctttaaaacaaacaaatccattttctttttcttttttttttcattttattttttccattattttatcaacacaattaattccatgtgtatcctttggtcctttctgtcccacagcacatatatatagtctcgctttacatactcattccatggccagtacacacaccacacctcattatatctttctttcaattcctatcctcttccttgtagtgtacccattttgaatgtgttctctctctctctctctttctttaggtccctggtgaatatctagaaccactctct

SEQ ID NO: 392 - DNA, 367 bp, Solanum lycopersicum
ataagtatgtgcgtaaaagtctaagtggagtcacgtgtgtatgatatgaggtcacattagaattgttactagaaaagatatgaaggaatcttttcatttttattttattttctttttacatagagtaaacaaaaaaaattgactggaattgaagtggtaagccaaaaaatgtgagaatacatgaaaaagtgtgagagaagtcacgtgtgtatggtatgaggtcacatgaatattattgccgaaaatgatatgagagaatcttttcatttttattttattttcttttttaaacagagtaaaaaaaattaagtgtgtatatatatatatgagaaatggggaaacaaattatcaaacataattaccattg

SEQ ID NO: 393 - DNA, 464 bp, Solanum lycopersicum
attacataaagatacaactataatctgacctagcttataaaggatgtgaaatctaaaatgatgatatataccttgataaaaaaattttgctacatcgccttttgcaattatttcattttgaaagtattcatatttgtttataaaaaattttcaaatattttaataaataaataaataaaattatattttatttatgattttcaaatatgtcaatgatataaatgattagctataaatctcataaatttctatatagacttattaaaataaagtataaaaagattttattttatttttgaaatacgaaaaatatgcgtgcttgagcctctaactacctcctatataaatgatgaaagaaaatgttaggtgtgagaagtatatatccttatcccaactttggaatttcaaatcgtttgattattaagttatttgtttgttgtggaaattaaatatgattcaaaggg

SEQ ID NO: 394 - DNA, 376 bp, Solanum lycopersicum
caaccctttaatgtcacatttcttgtttggtcttgtgaatttaagtctgcaactgtcacaaaaatcatactactatattaatgtgttgcatttatcgccatttttttaatactgttttcttgcttagcaaatattactatacttgggcggattctccaaatcccatgtgcaattaaaattacaaactttgttatttactccattttcttggatctctctatgacttgtctttttctaattttctatatatttaccaacatgttatgttgaattaaaagaagaaaaaaaacaagaagatttagttttttttatttttgtgtgtgtgtgtttgagaaaatgagtagtattacttattctaatttgatattgaagagga

SEQ ID NO: 395 - DNA, 434 bp, Glycine max
caaaaattaattcttttagtaatgatagaatctaatatcttaattcaatgattaattataacttaagtcttcctttaaaataaatctcatctcatctccttcttccttttttgagagagaatctcatctcattcttcggtgatcaaatctagtgccagtaccgtacttggtacgctaccttcacttgcctatgtgcttatcagctatcacctacctttcataatttaatataaaaaataaataaacaatgtcgctgcaaagcatgttcatgttcattaattcatttttattattaaaaaaaaaacacccctttattaggcggcggaaaaactcacggtatctttccaccactttctttatctttagagatcttcttttatatatatatatatatatagatagatagatagatagatacagagatgaaaaatact

SEQ ID NO: 396 - DNA, 269 bp, Glycine max
atcggatttcattgggatccatataattgcgttttcaatttctgtgtccttaaacaagctatgccagagaattaatttaattttaagtgttagctttattattttactttcaaatcattgaggaaaacaatggcctatatattattcctatatgtaacatacaataatgttattgcaatagcgtgtacttcaacctaattatttaataccaagtttctatattaatgttgtatcttatgaaatccttctattttccattctataaatta

SEQ ID NO: 397 - RNA, 36 nt, artificial sequence; identical to SEQ ID NO: 361
  synthetic construct

SEQ ID NO: 398 - RNA, 36 nt, artificial sequence; identical to SEQ ID NO: 362
  synthetic construct

SEQ ID NO: 399 - RNA, 36 nt, artificial sequence; identical to SEQ ID NO: 363
  synthetic construct

SEQ ID NO: 400 - RNA, 36 nt, artificial sequence; identical to SEQ ID NO: 336
  synthetic construct

SEQ ID NO: 401 - RNA, 36 nt, artificial sequence
  synthetic construct
aagugaaaaagggauccaagguuuuagagcuaugcu

SEQ ID NO: 402 - RNA, 36 nt, artificial sequence
  synthetic construct
gcagguucagaagaagaacaguuuuagagcuaugcu

SEQ ID NO: 403 - RNA, 35 nt, artificial sequence
  synthetic construct
ccaugucagauggugacggguuuuagagcuaugcu

SEQ ID NO: 404 - RNA, 36 nt, artificial sequence
  synthetic construct
uggauaggguagcuucuccgguuuuagagcuaugcu

SEQ ID NO: 405 - RNA, 34 nt, artificial sequence
  synthetic construct
gcgcuccuucuccuccauguuuuagagcuaugcu

SEQ ID NO: 406 - RNA, 36 nt, artificial sequence; identical to SEQ ID NO: 366
  synthetic construct

SEQ ID NO: 407 - RNA, 36 nt, artificial sequence
  synthetic construct
aguguugugagggagagacaguuuuagagcuaugcu

SEQ ID NO: 408 - RNA, 36 nt, artificial sequence
  synthetic construct
gaaccuuugagacauaccauguuuuagagcuaugcu

SEQ ID NO: 409 - RNA, 36 nt, artificial sequence
  synthetic construct
ggguuggaaauuaauugacaguuuuagagcuaugcu

SEQ ID NO: 410 - RNA, 36 nt, artificial sequence
  synthetic construct
auuucgccgcauauacacagguuuuagagcuaugcu

SEQ ID NO: 411 - RNA, 36 nt, artificial sequence
  synthetic construct
ugaaauuuacagcuacuacgguuuuagagcuaugcu

SEQ ID NO: 412 - RNA, 36 nt, artificial sequence
  synthetic construct
aucccaaucuguuaaacacaguuuuagagcuaugcu

SEQ ID NO: 413 - RNA, 36 nt, artificial sequence
  synthetic construct
gugauagcugauaagcacauguuuuagagcuaugcu

SEQ ID NO: 414 - RNA, 36 nt, artificial sequence
  synthetic construct
uuaggcggcggaaaaacucaguuuuagagcuaugcu

SEQ ID NO: 415 - RNA, 36 nt, artificial sequence
  synthetic construct
ucucucucaaaaaaggaagaguuuuagagcuaugcu

SEQ ID NO: 416 - RNA, 36 nt, artificial sequence
  synthetic construct
gaaaauguuugaaaaaaacgguuuuagagcuaugcu

SEQ ID NO: 417 - RNA, 36 nt, artificial sequence
  synthetic construct
auagagaagacuucauaucgguuuuagagcuaugcu

SEQ ID NO: 418 - RNA, 36 nt, artificial sequence
  synthetic construct
aauaauaaagagaucuugacguuuuagagcuaugcu

SEQ ID NO: 419 - RNA, 36 nt, artificial sequence
  synthetic construct
auuuuacuuucaaaucauugguuuuagagcuaugcu

SEQ ID NO: 420 - RNA, 36 nt, artificial sequence
  synthetic construct
cauuauuguauguuacauauguuuuagagcuaugcu

SEQ ID NO: 421 - RNA, 36 nt, artificial sequence
  synthetic construct
aaaugaaaaagaaaaaugugguuuuagagcuaugcu

SEQ ID NO: 422 - RNA, 36 nt, artificial sequence
  synthetic construct
aaaggaccaaaggauacacaguuuuagagcuaugcu

SEQ ID NO: 423 - RNA, 36 nt, artificial sequence
  synthetic construct
aagaaagauauaaugaggugguuuuagagcuaugcu

SEQ ID NO: 424 - RNA, 36 nt, artificial sequence
  synthetic construct
agucacguguguaugauaugguuuuagagcuaugcu

SEQ ID NO: 425 - RNA, 36 nt, artificial sequence
  synthetic construct
agucacguguguaugguaugguuuuagagcuaugcu

SEQ ID NO: 426 - RNA, 36 nt, artificial sequence
  synthetic construct
auauauauauaugagaaaugguuuuagagcuaugcu

SEQ ID NO: 427 - RNA, 36 nt, artificial sequence
  synthetic construct
uuuauauaggagguaguuagguuuuagagcuaugcu

SEQ ID NO: 428 - RNA, 36 nt, artificial sequence
  synthetic construct
caaaaugaaauaauugcaaaguuuuagagcuaugcu

SEQ ID NO: 429 - RNA, 36 nt, artificial sequence
  synthetic construct
aaaugaugaaagaaaauguuguuuuagagcuaugcu

SEQ ID NO: 430 - RNA, 36 nt, artificial sequence
  synthetic construct
uuuguaauuuuaauugcacaguuuuagagcuaugcu

SEQ ID NO: 431 - RNA, 36 nt, artificial sequence
  synthetic construct
uuuaauucaacauaacauguguuuuagagcuaugcu

SEQ ID NO: 432 - RNA, 36 nt, artificial sequence
  synthetic construct
agaaaacaguauuaaaaaaaguuuuagagcuaugcu

SEQ ID NO: 433 - DNA, 4382 bp, Zea mays
cccacaacaaaaatctacacagaacagacatagtggagcctaatcttacatctgaccataaaatggtgtaaagtagcagtgccctcaaagacatttccaaatatatctatatagatgatgtagccactaaggtagggactatgaatactttatggtagtacaatttgggagctattagggacagggccatacaacatgcatgataacttattgagtttgggtaaaatgtgccaatacttgtttcattggtaagaacttgcatttatgataattttatgatttagatggttttaaaataagaatgttcgctttagactaaagtcggctattcggacagatgtagctgcaatctataaagacaaaacacggtagaagtattagaagccggtacatattaaaaccaagcgaacaagcaattataaataaaataaatgcgaatacattttatttaatatttatatttaaatcaaatatgaatatgcatatctgtaacactaatggataccgggtgtgaaacatctgcatccataattgcatatctaccaccgtccaccgagcctgtatgactgtatcagtcacggagctggatggcttcgaaaagcccggcagccgctgtccagtccgacgcagctccacgattgcgttcagtcccttcccgggtcaacccgcgccacatcatcgcccactcaccgggccacggatcgtgtggccgcccggacacggcgggcgggcccccaggcccacgaggcggatcccgagccccgtgccgactcggacgcgcctccctcgctttcatcgcgagatacgcgcggacggccgcgcgccgctggtctggtcgtcatgacagtcgccgccgcctcgtcccacccgacctgaaccccgcaccgtgacagccacggcccaccggacgcgggaccctcatgtcggcgggcacgcacgtgcccccgcatcggcgtcgttgcctcgccaaggccgacgcggatccgagtcatcccgcgtcaccatccatttgacgaggcggtttatcccccagcaccccaaccaacctttccacgtaccaccgggtttctgtccgcgccccgcccttcaaaagcaggtccgcacgccggccggcgagacgagacgacaccaccacgccgggacgggaggcacaggtgcggtctgcgtcgagagttggtccactggcaggccggaatgaagaagtgcgcgtcggagctggagctggaggcgttcatccgggagagcggcgaggacgcccgcgccgccgccggaggtagcagtccggggtgcggtggatcaagcgatcccggagggagcggcgtcttctcacccggcttcggtttcgccgactcggtgagcactgccaaccacgagcaatgtgattgcagcaacagcggcaactctcgcaactgaaaatgcatctgtgcttatacaaagaagataggtagagttcgctacacttaattgtgatttcattaacgaaggatcttctcgcgcccgagcaggacaccatggatggaggcagttggtggtacgggaacgtccgcacgccgaacccagtcatgtcgcaggcggcgtccatatccggtaagcgccaaacatgatactgccctgctcctgcaatctatacaaactggaatttaactgtgtcgtcaaatgctgtgacctctgtacaaagggtaaagtaattgtgatcaactgttggtcagatattatgtgacaccacaaccatcaactatttatgacagtttgcacatgaatcctattgcgtttttaacagatcagtgttttcatttgtcgaaacttctagggaaattcctgcctgctaaacaggcctatttgaatgtatgttaacagcttgccgaaccgatttagagtactactatcacatccaaactatgcggggtttttaaaaaaaaaacgaaaacacccaaattagactcatgtcaagtattgctcacctgccgtattgcactggtcacagctagccccgggctaaccacctcagccaatcatgctcttgaaagcgagtcagactccgacagcgaatcactgtatgaggtagagggagttccatacgagcgaggtaacagatccattgagacgaagcgaataagaaggtacgaatagatcaagcctgtggcaaaattatgcaagtttccaacaaatgtctgagcagagaggtcactttttgttgtggggtgcattgctcctgtaaatttcaggatggtgtccaatagggagtctgcgcggcggtctaggaggaggaaacaggcacagttgtctgaccttgagtcacaggtaccataaccacctcactcacctggccaggaatgacttccaaccaatgatgtatactgcaagtttgtaggatgcgcactgacatgttgcctcgttatcaggttgaacgactcaaaggtgaaaacgcaacactgttccagcaactttcagatgccaaccaacagttcagtactgcagtcacagacaacagaatcctcaaatccgatgtagaagcgttaagaattaaggtgaccagttcgcttctcacagctgccagaacactgaaagatcacaaactttgcagctctctaacagtaaccaacccgtttgaatttgcaggtaaagatggcagaggatatggtagcgagaagtgctgtatcgtgtggcctaggcgaccttggcctggcaccatacgtgaactcaaggaagatgtgccaagctttgaatgtgctcacagggttggatttactagggagtgatgcgttcaggggtccaaccgcaggtacacgagtacagaactcaccagtacagagcactgcaagcctagagagtctggataaccgaaagtccaacgaggtgaccagttgcgcggcggacatttggccttgagcttcaagccattgatctgattcaaagcttgctccaccctcaaaaaaaggaccagagtttgtcaactcaaatagctggtggcttgagcagagcttctggcacgagttctcttgaaccatatttccacataagctttataggatgcatcactcttttgatgtcacttagtttcaagtataaaatgaagctgtctttgtacaaagctgcaaatgagaagtaaatgaaacgtcctggacaaacttgtgaagtaggaatgatacataggctctatttccaggtcagatgagacagttatgtttacaacaaaaagcaatacatgttgtttagaaaccgctattaattcacaggaatgttcaatccagtacaagtcatctagtagatttgcacccctaccttctagtagattcaaccatgttttcactactacttgctgggactacaactgtacatcatgatggtaaaatgcataactagtgaggttcttgactcgaaaccttcaggcattgtcaattgtcacttctacgtacacctcataaaaatttcaggcatctgcagaactgaaaactgatgtttcatagaacaggaatttttgttgtagtactcttggggaggttgttgtttacctattttgaaccttcctttttattattataatcggtagctctcctgtcgggctcgtttccaaaaacaaacgaacaggaacatttgtagatggatcatcttttcctcgtatttggtttacttcaagaatttaattcagaacatttcctgagaactaaaaatacaggtaatggaagaacgagaatgacaggaatcatacaaaacaagggttgaccgggtaaaattctcaaagaagaacaaaaccttttacttcgaagcaaattttgggtaggctacagttgaaacataacagaagctacaaatcaaggttgagacacttggatagctttttcattcactcatattaaagactaaatcttcgtgcatattccatctttttaattctccttttactatatcttctcatatcaacttcgatattttcatgtctctcttgctattactattgtgccttatgatccaatgcgcactagtgtagctagaggtctcagttggatatgttcaaatcatttcaattggcgttggacaaggtttttttcaattggtgctacccctagcctatcatgtatattatcgttctagacgcaattccttcttgtatgaccataatctatcacaatatacacttatctatttgaacaagatatctttttgtaggtcaatattctgcaccatacaacatagcagatctgatcgttgttctataaaatttgcctttttagcttttgtggtaaccacttgtcacatggaatgtcagatacctgatgccacttttcccaacatactttgatcctataactaacatcttcatcaacatcattattaatatgtagcactgatcctaaatatcgaaagatatcctttctagatac

SEQ ID NO: 434 - protein, 282 aa, Zea mays
MKKCASELELEAFIRESGEDARAAAGGSSPGCGGSSDPGGSGVFSPGFGFADSDTMDGGSWWYGNVRTPNPVMSQAASISASPGLTTSANHALESESDSDSESLYEVEGVPYERGNRSIETKRIRRMVSNRESARRSRRRKQAQLSDLESQVERLKGENATLFQQLSDANQQFSTAVTDNRILKSDVEALRIKVKMAEDMVARSAVSCGLGDLGLAPYVNSRKMCQALNVLTGLDLLGSDAFRGPTAGTRVQNSPVQSTASLESLDNRKSNEVTSCAADIWP

SEQ ID NO: 435 - DNA, 9054 bp, Zea mays
cagccttccgcatgctatatttgaatctcaataaacggtgctaggggggttttagcaaaagtacttcaatgttcaatactgtcttaatagacgtccttctctaacatcaaggagtacattgcgtacgggccctatttatttcggtttttggctgttagaatcggcttttggcagccaaatattttgtttttcagattgcttacatgagaatcgcgtctgtaaaaatcgtctaaatcaacgttaatataaaatcctaaattgtgcagagccctccacctttcttaacacacaacacaggtctcaggatattcaaatccatataagagctagattattcagtagtccagattccgaccaaaactctttaggatgctatcacaaacaaacatgtccatattctttcgtgattttaacgtatcgttttcgtgccctctaaccaaaacactcccaaacttgttttcgcttttcgaaaggaggctcgaaattatgaaactaaattttaggaataaagacacaattgcgacacaaaaataacctttttttacccaacttcacaccaccatatgtaggtcttcgtgctaccggatttgccaacacctataaaatttatgtcaggttgtcacggctttactattatcgcgtctaacttcaaacacatctggagatgcattgatctcgcgcgcggcttgaaaatttagttattaggttggtaaaagactaggttaggtaagaaatttgaaaacaaaaatccatgggagatgtttttacgtagaagaatagtgagaatttgagaaactttatttcctaagaaacaaagaaagttttggtgaaataattgaaacgaaaaattcgagaaactagaagcccgataatgcccttctcctctaccaactaccagcgcagtcactcgcctctgcacacgtcgctgatgctcgtcttccttccttcccatcctttataaggcccggccgcggctctgctcgcctctcctcccttccctcccgtaccgtatcagtctcccggattctctccggttcgtgggagggccaaagcttcgagttaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggtgagaggctgagcgctggctctgtgtttggctggttgcatatactcgcgcgcgttttaatttcgctccactctttgtttgaagttggtacgcgggggtgcttcgattatttgggttggatgctgttggaaatgatcgaaaccttacgtgctttgcttattggcttaggcacgaccgcacgagttggtgctctggatttgattttcgaggaaaaggatcgtgggaaataattctgttcttgcaacatagtactgtatatgtttatattttgtatgttttgtattttataaaaaataaacgattctatttaacgatggtctcccaatcacctctgttacggaatcaactttgatttttatcggatgtcttgcttgctagttgctatgtgacgagacggttggaggaaacaatcatttattgcggcttatgtgttgccttgctcggtgatgtgagaacgtcgtgcgtacgcaagtttcatgtttggacatgagacttttaatcagttcctagctttaataaaggaggagacagcttgtttgcaaacgacaagcaaaggcgctactcttttcacggtcttttttttttcttgttggttttttttcgggcgggatgggggtacccgtacccgaataactcagagagttgctaaaccatagatgtctgatttttgctttattttcagatggcaaacaacatctatctaatctacaactatcagaacttagacttaaatcttagaaccgaataccttctctcttattgctagtttatctttgctagtttatcttcacttacggaaatgtgaataacttaatattgcattagtgttccaaccttccaggctatggatctacggacggccttaaactagctgttgtctctactttatgcagcagagattacactaagcttttgtagttaattgaaccctaatccttggggcacagctaattctggtccacctagatatccttttagaggtatcttttgggaatgtgtgggcgtggtcaaaattggtcgtaatagtttggtcgtatggtcagaagctgcctgtggggtaacagatgaggggataagtcccagcggtctgagaagtacacaggagtggccagtggggttgcagataaagagataagttctcgcagcacgtggtcctcgctactcaatcttcactgcagctgatattaactgtagtcggtccagacttcatcttgtgggatccacatggtctacatcctgccgcgctttggtaatttcataattcattgaattccttgcatgtgcacatgtgcggggaagtactgatgcagatgaattgttgcactttgtattgtgttccagtaagggggtgtttggtttgtagggactattttttagtccctacattttattctactttagttacaaaattatcaaatatagaaactaaaactctattttagtttctatatttgtcaatttatatactaagatggaacaaaatgaagggactaaacattggtccctagaaaccaaacacactctaacatttcagacctaattgttgatgtactcgtggtagttcttatctaatctaataatacgaagataacgataaatatgtggtagctatctttctgaattaacgattggatgatatctcatattcatcgttgatgatacctgggagcaataatcgtgtaggtcagtcaaatgtgaccttttctgtgaaggtgattgtgtgtttggttttactgtttacacaacgggcaagagacagatcatgtagtttctgtagctttagcagtgaaacttagtgagctattttctccctaattaccgaactattttgacattcactagttgctgccttatttgctaagagttcatttaaaataagctgacttagtataggcatttttaaagcttgttgagttggatttggttagttctcaatttcccgttgcagcaccaattgcctacggcatgttgtagttgccggtttagtcttgatggataagttttcaatggacctcgtggttttcatttaagttagcactgaattaatttgctcttaaggcagctatcagtctgtcactgtttaccatttatctgtagttctctgttccagttggtttgatgttgactcatgtacctgtgctgttctgaccgtgacaacattaaaaggtggaaaactgctattatctaccgctagaatcttaatttggcttgttttttcaggatgcgtaataaaggtacataaattgagcaacttatacccagtctacctaaaatgggtttgattgatcaaatccatgcatgcaagtgatgaagtgaaggattgcgatgctcctccgttccaaattataagatattctaactttattggagagtcaaaacatctcaagtttgaccaaaattattacagagagaattacaaagatttatggcattaaataagtaaaatatgaaaatagaattaatgaagaatctaacaatgtaacaaaggtacataaattaagcaacttatacccagtctacctaaaatgggtttgatcaaatccatgcatgcaagtgatgaagtgaaggactgcgatgctcctccgttccaaattataagatattctaactttattggagagtcaaaacatctcaagtttgaccaaaattattacagagagaattacaaagatctatggtattaaataggtaaaacatgaaaatagaattaatgaagaatctaacaatacttatttagtatcataaatattattactttattatataaatttagttaaacttgagatgttttgactcttaaaaaaagtcagaatgacttataatttaggacagagggactgagggagtataaaacttatcttcttcatataggatcaaagagctgttcccatttaggcctgtttcatagtgagcgcagcaattctttcacaaggtaatattgtcatgcacatagaagtagagggtttgccattgtaggattttgcactccattgtgccactgacgtggtgaacgagtggcaatcctcaagcgccagaatggggtggcaaatactcgaacttgctttattttagaggtgtttggggttcagtatcatcagccttgaattttttgttacttcagagtcgatgttgttctgtagcatgctttgctcatttcaattttttatttagcaaaccttaatacactgtctgccactactgaacaactttgccatccttttccttacttcgttgtgaacaggagctacatctttccttttcactgagtacaagtatgttggattattcatgggcatctttgcaatccttatattcctcttccttgggtctgtcgagggattcagcacgaagagtcaaccttgccactatatcaaggaccagacttgcaagcctgcccttgctaatgccatcttcagtactatagcttttgtgcttggtgcagtcacctcactagtttccggctttcttggaatgaagatcgcaacttatgcgaatgcccggacaactttagaggccagaaagggtgtcggaaaggcatttattactgccttccgagctggtgcagtaatgggcttcctgcttgctgccagcggtcttttggttctttacattgctatcaatttgtttggaatttattacggtgatgactgggaaggtctttttgaagctattactggttatggccttggtggttcttctatggctcttttcggccgcgttggtggtggtatttataccaaggctgctgatgttggtgctgaccttgtggggaaggtagaaagaaacattcctgaggacgatccaagaaacccagctgtaagaatttattcacttgaattgttaaagcttccagttcttaagtgctatcttgctacactgcaactgcatagtgttcatactttttttctcgaacaacgcaatagagcaacgtgtcattttattaagaaagaataaaattatgagtccttacaaggaccaatctgagtacaaggaccaatttgctttcggtcatagcttatagctagcattctgcttgccatagtactagattggcatctgcaccatggtgtaagaatgatatcttgatgtacttgcaggttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggtatgcaaaaattttgattggccattgaagtttttagtataaagttcgtattacaatatttgtgttaaatttatcaggcacctgttcttatgtgtagttggtgtttgcgctggctaattgttggttttgatactaagtaattcatatttcagtctcattctaatttaaatttatcaggcaattgttcttgtgtgtggcggttggtctctgggctggcctagtcattggttttgttactgagtactacacaagcaatgcctacaggtatctagaatcttttttttcttgctagtgagtatgatggtagcatttcttgtttgcttccaatgtatgacatatttgtcgttttgtgttccagccctgtacaagatgttgctgattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagagaactgatgctctagatgctgcaggaaataccacggctgcaattgggaaggtagacatgtgcttgtcttatcagaatttcatgtgattgcacagcgaactaatgatatttcaagttttctgctttttccatttgcaaatgccagttaggattcatacatagttgtaatcttgcatgtgctttcatttaagagcttggacgcccctataaactttagtattttctatttagatcattttataccaccttcaatgcaattggttttgctagagaaaaaatctcatggttttgtatttgcagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatcaaggagatgatccccccaggtgctcttgttatgctcacaccactgatcgttgggattctatttggggttgagaccctctctggagtccttgctggtgcccttgtctctggtgttcaggttggtgggagttcctcgcaaatttcgatatgatacttgcacccgagtttttccttattacatttcaccattttcagattgccatttctgcatccaacactggtggtgcctgggacaacgccaagaagtacattgaggtaaagttacacgcagactttactgggccttgttttccctgcctgaacctgcataacaccttctctaaaaaggctttttttaagggaaaaaattatttataacattttgatctttggtttgctcaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttttcttgcagcaatcaatatggactttgcttaaaatttcgttgtcttttcaaaacgatatgcaagcaaaatggaagtgatgttctttgaaactttgtttcaatgctatagcaaaggtttgcattttacaaagttcggtttagtgacgaccatttagatgacatagattatgcttttcgtattttggtagcttctcgtgcggacgcgcggtcatgcctagcatgccgaagaccttgtcatatagtgaaaggaattgcggtagcaattagttcatttttccctaatcccctccaatcactttctcaccaaacaaactccaaaggtcgtcaccgaaggggacgttcctcccggaatactttggcaaattctgctctgtccttgcaaccaagcataacatacaagtgaccgaaatagacaagcaaagtatatcagaacattgtcaaattgcaagttgcaacaaaactgaagcaaacacaatgtagaaaccattcggagcatcacaggggttggtagcaatctgagatacatgattaaaggaatggtttaatagtacatgcacaattaaatgtttctttttgtttccaagctaggctatgaattgtccacgatcaagctaaaaccccctacccactaaacaggagactgctaggcaggggcgaacagggagcattcctgcatgtaagcaaccagccaaccaaatcacagccatctatcatttcctcttcttagtaggtggttgggggacatcatcgtcatcatcctcttcctcttcttcctcctcatcttcctcattgtcaccatccccatcatcatcgtcgtcatcatcctcctcttcatcctctccaccatcatcatcgtcgtcacttcctccttcaccgttggctgcaggatcgttatcatcgtcgtcgtcatcttcctcctcattcccattgtcatctgatccctcatcaccaccatcatcttcttggttttcagcatcctcatcgtctccctcctcatcattatcatcatcagactctccatcatccttgttctcgaaatcagttgcatttttgtttttgctcagaatccttgtggagaaggaaacaaacaatcctcagctttgggagacga

SEQ ID NO: 436 - protein, 766 aa, Zea mays
MAAAAILPELATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLGAVTSLVSGFLGMKIATYANARTTLEARKGVGKAFITAFRAGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 437 - DNA, 5374 bp, Zea mays
gtgtgacaaatcattgttgttccatctaattcagcaaccccaaacaccatggagtatattgcgccaatatggtctcagaaacgacctaatgcttgcaagagccaagaacgctgtgccgtgcttgggctgtagcctcggcccgtagtgttggcctggcccgacacgattatgtatatttttattttacaaaaaaacgtatatatatacaatatatattcaatattaaaaatatttgagcataatgttttactggttatacagtttcacccagtgtctcccgcccttcttttatcagggcatgggttcgaaccccacctcatacaccgtttttaacattttatgctaatcaaatgggtcgacagattaacgggctgacccgacacagtcagcagaccggcatgacgtgcctgggccaaagttgtgaccctcgggaccctcgggtgtctagcccgtgccggaccgtcgtttgacatctatgggcgtgtactggaccgtcgtttcacatctataggtgtgcagcgggttaatttgaaataactgtgaggcattaaatcggtgttttaagtataatatagattagaaaaccagtatatcaatgaatatatcaatgaatttaatatcatataggtatatattctatatgtaattatttttatcacgcgcgtgtcgggtatgcactttcactgtttaaatataaaaacaagtttatgtatcttatcggtaaaactgaatacttgagaacaaatcattgaatagtctattgtatgtatacggtttctagaacaaatcaatatttgaggaaccaggttgaggctagaactgttgtcctcaaagtcgaaccgtacgatacgtaatttaattctaccgctgacttcacctggcatcgcagtcgcaccgcaccgtccgttccggtagaacaagtcatcaatatccgcgaaagcagcccgtggaaatggaaaggaatgctacagaaccaatcaacaagccaagccaactgaccccttccgtcccggtgaagtgccaaacgcgtgattccattcgggaggcaggttggtgtgcgttgagccgttgattcctgcgcactgcgctgcgcctcaaggccaacgcccggcgaggacaggatgaggggacagcgggcgacgagagggaggaaaatcccagtccaactctaggcgcttcccttctcccttttcctttcttcttccctgaggcgccggccccgctcaggtcgggacctgccgccatttcagaactcctagcttcttctagttcgtggttgctgcgcgccttgcgtaccctggtacggacctcgatgcgtttttctttctgccccctcctcctgccatctcggttgatggattgctgtaaggtgtggtggatctcggtggattgctgcgaggcgtggcggattcgttgccggctcgtgttccgatgacacgcagtagctagagtttctgttctgctacattcctggctttcttgttatctgtttattgctagttcaccgcttgaatttgatcggacgtctccaccattgagcatgtggagaatacgccaattcggagatcttgcctaccttttccgttcaacggatgttcgtctgtgtacctatcatattcatctgtcagatctattattcttctcccatcccatatgattaattgggacatcatcgaatgtgtcattttcgccgtttatgtacgttatcctgagagaattcaatgggcccttcccagcttatcgagtttctctagtataattgagttttttatcttctctttccttctacgttgttaacagtacatagaacatgtaactatataattagttgctgccggcacctgtacctgctcattttcatattccaattttatatgtccaactggagccagatggtaaatcatctgttgcctttcctgacatggcagggctctggcccacataacaatagaatattgaatatttaatacttaatctaaattatagttttttaacctactttttttcacattcaaatgataatgaatataaacatatatgaaaactacatttatatgttacttaataaatatataattagtctaaaacgaattatattttagaatggagggagtagaagattgtttctttcctggatagcaacaactgaacacgtcggtgttatttgcaaatccagagctgggcccaaatctgggcatggtctattcctcatcttaactcaatcagactccacatatttatgtaaatattctgaaagcgaaagcaagtattactctgcagtgtctcactttgcatactatcaccagtgttgtgtaaaatacctttgaattatgttgtgagattgaattggtggtgtgttattattttgtattgtttaatattttcttatgtgtcatacatcatagggttgagcatcattggagtggaagaaaggaatcatgttcaggagaaagcatgcttctcattccaactcaagtgatgctgagcagcaagaagcaaaggtaactgtgataatcgtcttctcatcatagctcataagtttttgttcacgtgaagattttagagcctcctgtgaattcttatttacttggaagcccatagtaaatcatgctacgagtatgccccatagtccatagatgagtgctttgttcatatacttgttttatgactatgatccacttattttgcaatgaaacaccagagcctcaaggggcttatctatagcatgttatgtttgtgtgtcagtactagttcacacaagcctggatttaactatccaactgtatacatacatagctgtgtgttattgttgcagacttgcccttgggcctttataagcttgacaaacagttttactatctgtattttcctggttgatttctcacataatgtggcctacgaacagataaatgaattaaaatctgcacttggtcctttgtctgcccatggcgagaagtactgcagtgacacatgtttcagaagatatcttgaagcccggaactggaatgtcactaagtcgagaaaaatgcttgaagaaagtctcaaatggagggcaacttataagccagaggatattcgctgggtaaatgtgctcaagttactttgctctctgaatcctggtcaagtgaccaaacaccatgctaactgcctttcagcctgatgtttctgttgaagcggaaacgggaaaaatgtacaaggcaaattttcgagatagagaggggagaactgtaatcattatgaggcctacaaaggaggtaagactttctcttttgaactgacatccttgcgtttttttatttcttctccataaagatcatcagtcttctttacttctataaaatttcacgtgtatgtttgtataaaattccagaattcaacgtcccatgacggtcagattcggtttcttgtgtatgttttggagaatgcgatcctggaccaacgtgaaggtcaagagaaaatggtatggctgatagacttcacgggatggacaatggcccatgccacacccataaagactgcaagagaatgtacaagcatcctgcaaaatcattaccctgagaggctggccattgcatttctgttgaatcccccaaaagtattcgaagccttttacagggtaaaggcttttaaacctcctgcttttgtaaatgttatatttgtgtttgatttacttcacaaagattcaaaatctatttgtagaatcgatgcataaaattatgctcctgttttgatatccctatccttactcaagttttccaaattcttacaggctgttaaatatttccttgacccaagatcgatcgagaaactgaacttcgtgtacctgaaggatgaggagagcatgaaggtcctgtacaagtgcattgatcccgtggtccttcctgtggagttcgggggaaagaacagtgttgtgtacaaccatgaggactactccaagttgatgctgcaagaagatatcgaaacatcaagcttctgggaggatgatgcgaaaactgttaaccatgctatcaatgggaccttggttcctgatgttgcatctcagctgtcacggattgctgctaaagccagttaatgagctactacgatgggagctattcagaatgctttaatggagtaactagaaagtcgagcgccaataaaatgttcatagtaaacagaaatagagcaaataacagatgagatatcacttgtccatagtcgaaatagttgcacttatcgaacactttattcagtacacgatgagttacaggagactatcgtaatgatgtaagaggtagaagtgctacctgcttaatgtacctcaaaagcccttaaggctttacttgttttagccgtggctacggagaagctaattctgggttatggcttttaaaatgctggttctatatttggatttgattatggctgaagtagctcaccatcttatggattctagtagtagtggcactccgtcgcaaattatagtgtactttagatgtatcgtcgcaaacattatcatgctgtgatttcaacggccttatgatatacaccctgttgaacatctggaaggagagaaatctgaggatatttaaaaacagcgccctcacccctatccaattagtcctgaggattaaagaggacgtgttcattttcaagagagctatattccccagtattagggctgctgcagtggtttagctttagctgctttgtgcgggtctattggaaacgttccttacgttgtgtttgctagtttgtcttgtctcggtcctcagatctatacagtgtgttttctgaactctctccttttattgattaggcagagttcctgtcatttctttcaagaaaaaacaaccgtatatatcactaaatcaacgtggagttattttttgagggagatagtgatgaagatattactatgaaaaaagctaagagataataagatctgcaaaaacaacctcacgttgatttagtgatgtatgcttagacgtggtactgaaaagtttgccttaaattaggaaaggcagaccatgcacatcagtcttgtgttacattttttaactttaattaagttttttaaaatgtattatctccaagttaaaaaatgcactattaagacatattttatagagaatttatgaaactaaattgatgttgtaaatatcgatgtatttttctatagaatagacttagtccaagtccaagaatcaagaaagattaatctaaaataaacttaaagtgaactataatttccctgtaatcgagcttgattggtaggactgcatcagcaccatagatcattaagaagggagtgactcgagttgatctattaggtgtcgtccgaagacttcataggactgttggtagttctttcactccatctgcctacaaatgg

SEQ ID NO: 438 - protein, 295 aa, Zea mays
MFRRKHASHSNSSDAEQQEAKINELKSALGPLSAHGEKYCSDTCFRRYLEARNWNVTKSRKMLEESLKWRATYKPEDIRWPDVSVEAETGKMYKANFRDREGRTVIIMRPTKENSTSHDGQIRFLVYVLENAILDQREGQEKMVWLIDFTGWTMAHATPIKTARECTSILQNHYPERLAIAFLLNPPKVFEAFYRAVKYFLDPRSIEKLNFVYLKDEESMKVLYKCIDPVVLPVEFGGKNSVVYNHEDYSKLMLQEDIETSSFWEDDAKTVNHAINGTLVPDVASQLSRIAAKAS

SEQ ID NO: 439 - DNA, 5616 bp, Zea mays
tgtcaatatatgatatggatcttaatgttgtttaacatttaatatgaaatgaataatcatcataatgttacatctgtaactatatttttatatttataaatgatgaagacttgttcttcatgaactttgtccgatatccattatgtccgaaaggagataatgctttgaaggacgaagatctttaatgtttaataattatgttgtcttgttttataattcagtaataaaaaacaagagaccaacaaatacttcataaaaaatctcatatcttggcattttaatcaattggtgccaatgtaagattagagtttgggatatttttttttgacttttgaaccctatatagaataatcaacgatcaatcatgaatccgtgagattgaaaaaaatatacacatatatataatacaaggactagtacaccacacactatggctgcacatcaaaagaacacacactcactgtgtgtcgccgtgtcgcactagtagtttgcgacgatttgcttcgtctaaaacaacgataaactcaatgatttgtttcttagattttcagcaaactacatttaacgaatagctaacgaatagattactgaatggtgactaaactaaaaccaattactaaaaatacatgccatacattatatactcgatatatataaggggcctcgcagtttcgtagcatgtaaggaatagtttatttgtgagactagtggggttttgtggaaactaaccgctccaccttttgaaattcttcttcttcctggttttttccgtgtggttgctttgctttgcttagcacaggcacagcgcagcacatgaggagaagaagagggagaagagtaattatttactaattaacaaagaagagaagacttcttccttcctcgtcgtctccagcccattccaattcttgattccatcgccccaccatccaccactccccgaatccttccaacctcctcgtcgtccagtccaccacctccacgcgcaatggccagcggctaggcggcaccaaccagaaatcacaaggattcgtttcatccggcagcgcagctctagagcctccatgggcagctacgcgtacaagtactgcatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcgccatgctctccgggggccacagccatggaatcgcccgcctcgtcacaaggtcgccggcggcatccacgcccacgctcgaagacttcttggccttcctcttctcccccgacctcaacccacccatcgcgcaccaggttgttgttaatcgaatgcatcattctactagtactgaagctaatttctctgctggtggccgacttattcactgctcaatgcgtcacgtagctgtggcttgttccacaaagactccactactacctgtctgtctgtctcagccaaaggaattgggagccctttctctccgtctctgtcaactctgttacctgctgccattctgtcgggatggggacataaacatcgcagctaccaattagatagctgagtgctagtacacatcgatatcgatgtatagagacagacatgttttcaccaaacacaggaaatcacctttcttattgctcttaactctaggtggcttcatgtgcctttagattgcttactatccattgctccctgccatctcgaactgaaagctccagacaaaacacaaaacacggacttcattatagcaaattgtttttgtttcgtcttactaaacttcgcctgttctctcatcgtttttaactctttgcccaggttcaccaggacatgtcagcgccgttctctcactatttcgtgttcaccgggcataattcctacctcactgggaaccagctcaatagtgactccagtgacgtcccaattgtaaaggcgttgcagggaggtgttagagtcattgaactcgatatgtggcccaatccttcaaaggacaatgtcgatattcttcatggagggtacgaatgctgtttttctttgaaacattttcactttttttatagcgcacggatatatttgcgtatgaaagcaactgcatgtgtgagaggaatgcctcagaattttgcttagcttattgctttatgtaccatgcatcacctttcttttctaaggaaatcaccctctcacttcacaaaatgtttccctgacttatttttcttcgcatttgaaaggacattgactgccccagtggaaatgatcaaatgtttgaagtccatcaaagaatacgccttctgtgcctcaaattatcctcttgttattactcttgaggatcacctcacaccagatctccaagctaaagttgctacggtatagtctacttaccacatcacctcattgcagatatcatgtttgaaaccttgattctaacttcaggctgttttatagatgctcactgaaacatttggagatcttcttttcgtccctaatccagacccgatgaaagagtttccttctccagcatctctaatgaagagaataatcatatcaaccaaacctccacaagaatataaggagtttctcaaagctgagaataatcgcagtggcagcggaaacatagctgagttgccagaccaaggaagcctgagaagaatagattcaaatgccgatgaatctgatggaaaggtctgcaatatcactgccttgtcaagaccacacccatgatttaacaaaaatgaatgaagtaaaccttttgtcataaacaggatgaactggatgagcaagacgaggaagactccgactccgacgatcccaaatttcagcaggatacagcctgtgagtataggaaactcatcaccatccaagctggcaaaccaaaaggccatttgcgggatgcgctaaaagtggatccagataaagtcaggcggctttctttgagcgagacacagttagctaaagcgacaatctctcatggtgctgaagtcataaggtaatttgtgtgcgcaagaacactagaagattttatgctgaactggtatacagttctgtggacttcgtgaactcaatattttgcttatgctcttaaatcatactcctctgtttagaccataggagttcaacagttttagattgtagtctttacattatgtaattgattcgaaaaaaacggaaaaataaactgccagtgcggccagggttacagggcacatatgatgattcgataaacgtccaaatttgcctagtgtcctgcaaaagataaccaacacaaaatgataaaaacacaaaatcacctatctgcattaatcgaaccatctaagttcttgctgaatcatctaagttctatttaggttcacacagaagaatatactccgtgtgtatccaaagggcacgagggttaattcttcaaactacgatccaatgaacgcctggacccatggtgcgcagatggttgcattcaacatgcaggtgaggtttcagttgttagctgccatgagcctctgattcccacttccttgtcgcagttttatacttacttgcctaatgttaggatgtgtgagacagagcagtaaggcatgctttttttttcattttccagggccatgataaagcgctccggttgatgcaagggtttttcagagccaatgggggctgtggttatgttaaaaagcctgacttcttgctaagaacaggcccaaatggggaagtatttgaccccaaggctagtttgccagtgaagaaaaccctcaaggtaggtgtatgtgtgtttccaagacttgacaacagcgcacattgagtttttgttcaaagtatcagtcaagtaatttgctagatgcacaagcaggtgaaagtatatatgggagacgggtggcgcatggacttcagtaaaactcatttcgatgccttttcgcctccagatttctatactagggtaaggcaacaaagcatgtgttgatctaacggaccagaagactcactttacacctaaggactgtttgcacaacagtcgtgcaatagacaaggtaaaattacagtgatgtgatctcgtgcaggtagggatcgcaggtgtgaaggcagacagtgtgatgaagaagacaagggtgattgaggaccagtgggtgccgatgtgggatgaggagttcacgttccttctgacggttccggagctggccctcctgagggtagaggtccaggagtacgacatgtcggagaagcacgacttcggggggcagacagtgttgccggtatgggagctgaagcagggcatccgtgctgtgcccctgcacgatcgcaagggtgtcaggtacaagtccgtcaggctcctcatgcgatttgattttgtgtagccgagccgagccgccattcagattcagcttcttctttttttcccttcttgtgtgaattgaatgtattactcccttccttccatcttcaacgtatatgtgtatgtatgtacttatttttgtcggaataaaagttgtatggaatggaatggaaggaaggagtagaactgtcttcaaactccagcttctagatctgtacgggtgattcagttttacttgctggcacattgtttgtctgtttactttactggagatagatttgtacatgagcttgattattcttcatttagctactggctaagagatagattagccaatgtgtttgaaagcctttatcatggctatatgaataatataaggaggacacgtctttttgtatctccttgggtttgtattggctaagagatagattagccaatatgtttgaatgctcagagctttaggaccctagtgcccatgatcaatgtcgagaggccctcgtcaccgttaggccctccaatgaacccttggagccaggggtggatccgggattggatcaaatgaaggactataagttaaagcatgtttggcggagccaccagcagctatcttgggggtgagtgccacgacgacgtcctcgcaggactgatgtactagagtgctacagaaggtctgccatggtgctgcttgcaacaggggcgaagccaggatccaaaaatagagggggccaaattagattaagaggggctgttagaagcattttttttgcactatttacatgagaattagctaaaaactaacacgtcctatagaattaggggagcattaggggggacattgctcccataccccctgtcgtcgcccctggcttgcagcctgtcccttgcgttggtacatgcgcgctgctaactattagatgtgcattggccgtgcgcgctagctcatgactgcgtcctgtgtggtggcgtggatttgcactgctgaagcatggacggggtccagtgtggatgcgcgcgctaccacctagcatgctggtggcactgatggaggctaaatacatgtgctgaatgacacgatcagaaagaaggttgtggtctatcttagttaacctttataggatgtatttatgttataatatactcccacgttccaaaatagttgtccttttagctcttggtttttatgtctatatttaaatagatgattaagtatcccttaaatccaggtgtgacaataatat

SEQ ID NO: 440 - protein, 586 aa, Zea mays
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHSSYLTGNQLNSDSSDVPIVKALQGGVRVIELDMWPNPSKDNVDILHGGTLTAPVEMIKCLKSIKEYAFCASNYPLVITLEDHLTPDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLSVKKTLKVKVYMGDRWRMDFSKTHFDAFSPPDFYTKVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 441 - DNA, 11018 bp, Zea mays
tttataaatgatattgatgaatatttaatatatacacgtactaattaatatatgtacatataaaatgtacaagcaagtagttttttttcaaagggacatgtatataaatattaagggtagctctttccaataggacattaacacaaatatacaagtaaatagtatagtaatatatgtacaataatacatacaaatgaacagcaataatagttcttgaattgcttcaatcttttgcaaagagagtagttctttccttcatctttataaactatgatttcaaaaaaaagtattcttatattaaattcaaagctgaaatactttatcaaacccaaattaaacccaaagagagtagttcgtttctttcttcttcaagtgttcgtcacatcggcattgtacatatatacataaactttccttcctttcttcacgcttcacctttaactcggcactggtgaaaacattatgatagacggaactagcatggattacaacattaataataaatatacgctaaaacattctgatagataaagactgataatgtgatcaatagtacagacaatagttgatatgttgatcgataagagttaggtgcattagagcatctccaataataacaataatacctcaaactggtgtctcaaattgaaatataggactctacacagaaaaactactctaacgatgtcttattttataaaatttgattaaaacagtataaagcattttctcaagtgcctcaaatatattacaccatagtgacttccctataatatagatttatggttttaatgttgaagcagaatgttttttatgccataaattctataaattatatttatttttaaattataaagtatttttatgttatgctgttggagaaccactctcctagtgaacaccaactacccaaagagagtagttctccctctcgcacccacgcggcagcccccacggcgtgctataaatacttcacgaacggcccggatatctccatccctgcatcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataaggtatgcctcttgccctctccaaacccctccgcgagggcctagggtctggcgtgctgagctggagctgatggatctagggtttgggttgcggtgatggtcctgcagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgagtaagtgcctcagctgcggctgactcttacttttgcttggcttgttgggaatttggagtggcgttcagggctttagcttggctggggttttgtgttgacttgtccatgtccacgtttttttgtccgctctttgcagagcgagtgacaagtgccagagggagaagcggaagaccatcaatggcgacgatctgctgtgggccatggccacgctggggtttgaagactacattgaacccctcaaggtgtacctgcagaagtacagagaggtgcgtacggtgtttgggaatttgggggtcaggtcgtgcaatcgccaatctgtcaccttgtcgatcgtacctctgattgaacttaaataatcctgttgggcatcagcacgctaataagtgataagtgagctatccacttcccttccaatgcttcgggcacatatttatacttctttagttgaggacataaagagaccccatgttcctcgggtaatttgctattttatcactctcagttgtggacttctctattttaccaccaggcccacaaatcatagacacaaatcatagacagagggtcacataatagcagagagcctaccttagaaaggctaaaatagcaattttttcctgttcctgtgtactactccagtaaatacagctagtaaacacattatttttataaggtgaaccaattcgaaagcacttttatccatttaatactgaacagtgatcgaaacctctatttggtgttcttacatgggattgagttagcactcgtgcttgggacgatattatatctactcacaccctatgtggctgtgtctgttctatgatgaaaagtagatgtaatgcaaatggataagagcggaaagagctcctacagtagtgtaattagagcatgttgtagtgcaagcttttggttgtttgaataatgtacctttacacaaaagatacatgaaaccattccactgtaggtcatatacaatcttgcttagggtcacgagtttattgggaacatatctggtgcacatgatgtacatattaaattatcaccatccattctagatctaacgtctttagttgttcattctagatctaacgtctttacttgctctgtataattgtatattttgcaaagaaccccttccgccactactctctaccacttctaccctgctcggagggtgttagatctaggatgaaatgatgaatgatggtgatctaatatgtacaccatgtgcaccaaactcagtgcaccagatatattctcgagtttatttagctgtatttttctatacgcccttcgtattgattgaataatctgtctaatgaggtttctcttttggtcttatgtctggtggatggcatcacggactgcagatggaggtatgtggtattaagctctttgagttgtagttcatagtatatttttgcttgatggtgaatgttatggtcgctagatcggtgagggattggagagggggtatcgatgggcaggaacgtcggccgggggcctctgcccacggccgagcaagaggagggtttctcccttctaattcttgtctgctttatttctcatccattgattacataaataggccggttggctgcccctatctagctagagatccttatctcctaaaaactctcaacaaactactaactgataaccttcctagataatctcaactaatctcctaaataatctcaactaatcttctaatcttatctctaactatccttatctaatccccattagggcccatggctgctgctaccgcagcccctctgtgggcctccttaggtcctgacactacacccctcctggacaagcagctcgccctcgagctgccgcataacgggtgctcaaagaccgagtctacttgcccaaaaccaaacacctagaagacaagccttttacatctcagcttatcttattattccgaatctgatttttttaccccataagataaggcgaacacgcacgtgtgcagccacctggatcccatggacgccatctgcacgaaaggggagcacatgtatgggcacctggaataggtcgcaacaataaccagcggaggcgcccctcgtggcggccggtagcggaatgtggtggcgctaaatagtgtgcccttgttgatgacgaggtgagtgtcttccctaccgccgctgtcgtagagttgaagttcgtcgcccgcgggacacgtatcatgctcgcacttcgagatagcggcctggtgccactgctgatagccgtctgacaaggtgaggtcgcgccgacgtgtgccgaggtcaaccgtcaccaaggctgccttgagcatctgccggcgcatctcccacactttctgtcgtgcaaggaagccacgagcagcagcttgtatgcccacagccgtcgacgtccggagccgtgcggacagcgctagctggtgttgctcatgttgcactgctgccttgatttgcagcagcccttgcatctttgtgagatcagcccttatgttggtccacaaatctcccatcgatggagctggtgattgctgagtcgtggctgcccctagtggcgtcgcccatggggacggagacgccgtcaacgaagatgatgtgatgaaatttggcgttgtccctggggatgggcacgccggcgtccaggatgtggtgacaaaattggcaggcgatgctgcccatggagatagggacgccggttgccaggacggcgtgacgaaggtggcatgcggcgcagcccatggagatggggacgtcggttgccaggacggcgtgacgaaggtgacatgcggcgttgtccatggagatggggacgccgattgccaggatgacgccgcgaaattggcagcagaagccatgggatcagatcgaaacccaagctctctgataccagatgttatggtcgctagatcggtgagggattggagagggggtatcgatgggcaggaacgtcgactgggggcctctgcccacggccgagcaagaggagggtttctcccttctaattcttgcctgttttatttctcatccattgattacataaataggccggttggctgcccctatctagctagagatccttatctcctaaaaactctcaacaaactactaactgataaccttcctagataatctcaactaatctcctaaataatctcaactaatcttctaatcttatctctaactatccttatctaatcccccttagggcccatggctgctgctaccgcagcccctctgtgggcctccttaggtcctgacagtgaataactcttgtttttcatattttaaaacattggtctgtaaatgttttataacgtggaattttgttgtaagaaacttagaattggcctgggtaattggagctagctgatcctgttttcaccctgacttgaagcacatgtgggcagttaaattgtttttgttcacattcttgaggcataacacattaactgaatgcaatggagtactgaagatgtcttttctgggaagtggagggttcttgtgaattggacctttttgtgaacgaatcttcggccagttcatgtattgattccctgctggcagggcaataaaaattagatggatcagtgaatcacatgcatgttctttattagaaaattactagtcataaatgtgctcggagtcccaggtcttcaccatataaactaaagttatttgcctgatggatttgacctccacctgattctgatactatatatttatttggtttcactaagggcatgtttgtttaatgctcaatccatgtggattggacgggattgagtgggattaaattctgagtaagtcaaaatccttcataattttttttccaatcctatccaatccacatgtgatgggaatcaccgaacaaggtctaactgtttggcaagttccaatcctgtacaatgattagtacatggatataatatttttctttctttctagagggtttaggagtagctcttcttattgtccatgatttagttaccaagcttatagaatctgagatatataatgaacattactctgctcttgtttctttaataaccaacagggtgatagcaagttaactgcaaaatctagcgatggctcaattaaaaaggatgcccttggtcatgtgggagcaagtagctcagctgcacaaggggttaagttttcttggactgttccgttattcttgtgatcatactgcaaaaggctaactttctgttacttttagatgggccaacagggagcatacaaccaaggaatgggttatatgcaaccccaggtgattgacaaaaaaactattggtagttgctatttgttgtgtgtttgtgtttataagcacaatgtatagcttgggtctttgctgtagttgtttatttactgggttgcaaactcgagcatgttggattgccagccccttaatttattgcagatgtgcaaatcagttcccatcttgcatttgcctagctctaatgagtattgatttggtgtccccgcaacaatttgctcctgcttatctgtagtgactattgaggtgccccccactaacaaatttctgtatttgttccagacatagcgccacctccatatgttaaagttttttcttggtctataaatggctttttaatgacactggttggcatccatatgtttgctgataacccttctctttcccttctgcagtaccataacggggatatctcaaactaatggaggtatggaccttttctgcgacagctgctcttacctgaggtacaagcttatgctttcagcaaattgctgtgttgctttgattcccatatgcgatatctcatgtgttgctacctttaccacccaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacatatttactgttcaccgaaatacttgtattgatgtatttccgcatcaattatagtcatcgtcagcttgtaactacggcaatgaataaataaaaattcactgagtatataattgagcaaataaaaattatatagttcataaaaacaaatattacatagtttgtaaaccataaataaaaattagcataattcattggtcctagccggccatttggtgggagccaagaggttggatttactaaaaaaatattttagcacatgtttataagcctgtttggagtgtgaagtttaaaatagactgagatagaaaatgagatagcctaaccaccccaacttcagcttcaccaaaaacaaaaacaacagcttttactacatgacaagttggctaaacggtttagtttcactaaattggtgaatgtagaagtcagactcaccgttttgataagcttattgagagttgctccaccaactcaagtttaataaaattgataaaaaaaaatactaaccactatcacccaatacacagtttagtggttcgctgttatatttcgcgtcacttcttctatcctccccaagtatgccccggccataggccatgtccctccctggctcagacaaacctcccctaatagtaataggttttgtcgtctccgtttctttacgtacaaattaaattttaagtttatattttttaaggtgaccgatgatatcgtaacttatgttagaaaaatatattaaaatctgatctctaacctattaaaatgattctaaaaaaatataatatatttttctacgataaagtatgacattaactactaaacaacaaaaattatactgaaaactcaacttatacattaaaaaataaaaaaaacaaattttgttaaggatattaaactaactcaagtagttggacttattcctttcaaatatacatcagccagcgactagcgagcaagaaaacataatgcatataggattccattacattaaccgtgaatagcagaggacaaaggcttccactgccaccaatcatgaaagagtggaagatgcatacaccacaaaaaaaatgctaaacggtttgcagacttctcgatgaccaatgagaagatagaattatctaaatattctacgtaatatgataaaaggattccagaacacagttggttacaaatggcaaatgatacaagaatcatttgatccaagtagataatctaaagactcgcaagcctaaccgttaaatgtagtaatgaacatgccttccccctattgattcaaggctttcactcagtcactgatcacctgagcattgaactgacatataggaggaaattgtgtttatgacaacaccaacacgtacgcgcccaatacaactaggtgaagtttatagagcaaaaaagggggagaaggatatagatgccctagttgtcaatacctaatggccttatgatgctaaagtagtttcaggttttctatacagaacacatcatctaaagttctagatgagagaatcagttgagcaaactacgtcgatatcaacagaaactgacaggaacgcaaggttcgataagctggtttactcacttgcacctgcctgcttgtacatctgatgcctcaaccgaggtatcctctatagtcttctccactgctagagcatcctcatctagtgctttaactgtggcacccagagcagtttcttcggcgttggtggtatttgtacctggtggcgcaaccattgcatccttcagagtattctcaactgttgttgaatcctcatttgtcgcgactgtggcattctctacaggtttcccatctgctgtagacttatcatctagcaccttaacatcctctaccgtttcctcagttgttgtagcttcttcatctggttctccagctgcagtttgatcttcagttatctccctgattattggttcaacaatacctttgtttgctattttctcatctggtgcctctactgtaatttcacattctttggtctcaccagctggtgtgtcagcatctgctttaatttctgttttctcatctggtgcctcaactgtaatttcacctgccctggtctctccagctaatttgtcagcatcttcattattttctattttccccttctcgtctggtgcttcctccttagtttcaccttcagctgtctcctcaactactcctatggtagcagcattattctctgtactctcctcgagtggtactacttttgcctccacagtttcatcaaccatgaccatagagtgctcaatatttgcatcagccatagattcatcttctgaaattcgtcttcccacctcaagttgtccacctgatgcttcaattacagcttccatgttaacagtctgctcaatactatagccttgttcgcatgacacttcaacagtagttttggattccagttcaatttctacttgctcgactgcaccttgtacgacaggttcaacagtcaaattttcagcttgtgactttggatcttcaggtcccactttttgttcagtttcagattgccccactagcttctcaccaggggtttgactttgtaacacaggaaatacagtgtgctcttctggaacttcatccccaacatcatcctcactatgatcttgtgcagtacttggcacttcagtgacagcttcaaatacagcattatctcctggattgtgactctgttttggggccgtggctatatcagtttgcatattatctggagccttctgaggcaactcttttattatagcatcagaatgtaaggtttctatctctgtgggtagatcactgactgacgctgccttttgagtgtaagcttgctcaatgtcacccacttgctgagatgactcttcagatacagatgcagcttctgcaccttccccaatctgattcacatggacaattagctcagcatcaatatttcctgctttctcaagcctgtcaacttcactgacaaatgtactgtctgcagcttccactagacatgtttgccttacagtctcaacttcttcagatgacagttctcctgtaacttttactttatctgttttctgcaccaggtcaacttccatggaatccttaggagcttcggacatattcaaacctagaggaaagacatgatcacatggcagcaacaatcatttgcttttgtggaagttgtagagtagctttattaaatactccctccatttatttttctaaagtgtatttggattcgaaaaaaagaatgtagagtatactttgactatcaattactctcatgtaatatgccatatattgcagtaaaaccaacttgtgttgaactatatggtgaatgtgaattcgttgatactatgtcctaatcatgaatataattagagttatgttggtcaaaatttacaaagttactttttaaatcctaactaagtaactaatatgccccatattttgaaacagatgtaccatgcatggacatgtaaattgcaagaatgtttacctggaatctccaagccatgattttcaggattatttgctgattgtgtctctggagaaagtggcatactgacaagacggtaacttcgaagcgaaggtccaaaagtgctatacttgcctgcagcactaaaagccctttcagcatcgacacgtttcttgaagacaaccttaacagtatttgtttccctatgtacttttgtccccctttctttcagtggaccatagagactgaacatcttaacaagatccagttctgaaggaatagacgctgacctgccaaaggtcaaaacaagtgcagtgggcttcaactcatcaaccatcttctcatcgacatggatgatagatctttccatcacttgtatctgttttttaggaaccggctccccaagttccgacaaaggtatatatgcatgtcttgaggatctccgtttccgtcttggccttgtagtcggactctctctttttaggtcatgaactgggtgattatacaagctcaatccggaccaatacgagtcctgcatatgatccgttgtctctacctcaggagaaggtataacttcttttctcttcctccctcttctagatgtacctttatcaacaatgtttgcttcagtagtagtagaaacaatatagtttctgtaatcgttgaagtaaccgattatcattgctgagaaactatatccattcattggctctgttgcaaccaagcatagttgtgacagtaattccctgggatctgcagcgtgatttatgtgcagacgcctcctttttgctcgtttctccacagtaagttcatcaccagcatcatcactagagacatcaaattccccattctctccttcagcagcgttattatagactg

SEQ ID NO: 442 - protein, 178 aa, Zea mays
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 443 - DNA, 5618 bp, Zea mays
taaccaaacagggtagggaccctttagttcactaactaaattttagtttttggactaaaggaaccaaatacccacttagcactagaaaacagacataccctttatagaataatttctcatgagaaatcgggatatgaaatccattgacatctctagttaagggcaccggtgacgataactttgaaacaaaaaaataagaagaataagagataatttggaaactctatttttttcgagggatttttatttttctaaaaaagtaactaaattttattagaaaaataaaaatcatttaagaaaatgaggttaatggaaacccatttttccaaaagatttttatttttctaagaaaaattagtttattttcctgtataggaaaacagaaatacccaaaataggttctaaaactagcactatttgcaaactcaaacttaatgggtgtttggtttctagggactaatgtttagtcccttcattttatttctttttagtatataaattgctaaatatagaaactaaaataaagttttagtttttatatttacaattttagaactaaaatataataaaatgtagggactaaacattagtccctacaaaccaaacacgcccttgtaattttccatcggtatgtcctccgtcttcccgaaagccttcattcggctcgctgtcttctttctatcgctcacaaccaacaaccatagcccacaggccgccggcggccgccagccgacgtcctcccatttcgctccccctcctccgctgcggtcgagcaaaagttccggccatccggcaatcccccggcacccggcggttcaaatcgtatctttctgacctgacgcggctacgacgtcgctcctccggtcccttcgatccggtggggtccgtttctttcaagcgcggcctcgctggccgcctcgtggcagtgaccgtcgaaccctctataaatcccgtgccccgagcacccttcctcgatcacacaacccaaagcagccacagcagcctccttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccaagtccgtcaagtacaacttccggaccagaaccgccgtccccaagctcgggtatgtacggatgcagcggccctagcctcactctctgtgaaccctcctcctcccgtgctcagtcaaatcctccgtcgagatcaactggtcggcgttccctcctaaatcctaatgaaaatcttactgctttgcctgaagacgaaccgtcgtaattgttgacagctacgcacacacttgcccatccggatgcgtcaaatcagctcgatttgaaattcgattcgatggtgcccttttccatatttcgatcatccctcgcctactgtgcaatgattacagaaacgtccttttcctctgaactttgtcttaggctttttgtcctgtgcacgtgagctggtatcaatttgttcatgtaagatcaaattccagcagggacgatgagcagcagacagaactcattacactagcaaattgatactaggattactggcaagtgtgcatacggcgcaatctgccatcctggaccccctttgtttaattcctgttcctatgcatgttgcctacgtgcagctcgttgtgtgttatggtgtcaggctgtcagccgcttgtctctgtctgacggatgatgccaacttttctgttctggtggtgcagggtgatgcttgtggggtggggaggcaacaacgggtccacgctgacggctggggtcattgccaacagggagtgagtagtacttaatttgtcctatattgctttccgttgttttcagttattaatggcctaacagagaactgaattttgttgttggttgtttcagggggatctcatgggcgaccaaggacaaggtgcagcaagccaactactacggctccctcacccaggcctccaccatcagagtcggcagctacaacggggaggagatctatgcgccgttcaagagcctccttcccatggtaatctattatagacttgactaatactcttctttttactgaaaccaaacatacataacaaagcatattccgtaaggtgctagttgatgttataaaatgaacctgtctttcaggccagtggtctcaagtaaacggaatgttaatcattgggttgaaaaaacaaaggttctaattttgtgaaaggaatgttaaacttagcataatgaaaaggggaagcattgtaagaaaggtgctgaaacaatcgactcggtctgccatgttgtgatcctacttgcaagtcaaaaggttctgtggttagctcaaaggttccagcatctttggattacactcgtgcagtattgacgatggtgctaactggttgcagattcgcagactcggtgtttgttatcttcttttcatgaccaagtgttgaactggttttcaggtgaacccagacgacattgtgttcggaggctgggacattagcaacatgaacctggccgactccatgaccagggccaaggtgctggatattgacctgcagaagcagctcaggccctacatggagtccatggtgccacttcccggtatctatgatccggacttcatcgcggctaaccagggctctcgcgccaacagtgtcatcaagggcaccaagaaagaacaggtggagcagatcatcaaggatatcaggtatatggatatggatgctaacgtgccttggtgctaaggtgcacccagtgcaacctaaaacaaataaatactactatgaatttggtaaatatacatacatatcagaacatattgtttaaccggtgcacttagaagtctgcatggtatgttggacaatttgacattcgatatacagtgaccgctcacttgcatgaggactccacaaagaactaaaactactgaaagcttaagcaactattcgtagctaatgatgtatttggtggacatggtttgaagatctagattaacgtggttgaagaaatatggttcactagtataagtaatccattacagaagctatggcttatgtagctaatgaaacagggagtttaaggagaagaacaaagtggacaagatagttgtgttgtggactgcaaacactgaaaggtatagcaatgtgtgcgctggtctcaacgacacgatggagaatctactggcatctgtggacaagaacgaggcggaggtatcaccatcaacactatatgccattgcctgtgtcatggagggggtgccgttcatcaatgggagcccccagaacacctttgtgcctggtgcgtggtttggtgtgtttgcaaaagcttcatggtgttgcatttctgttccaaagtttcatggtgttgtatttctgttccaaggcttattatacctgttgcatgttcgtagggctgattgatcttgctataaaaaacaactgcttgattggtggtgacgacttcaagagtggacagaccaagatgaaatctgtcttggtcgatttccttgttggtgctggaataaaggtgggaacctagtatctctcttctattaagatgaagtgtttttttggcaaatgacgttattgcaataactcttctatattttcattttcatgcagcccacctcaatcgtgagctacaaccacttgggaaacaacgatggcatgaacctgtctgcccctcaaacattcaggtccaaggagatctccaagagcaacgtggtggatgacatggtctcgagcaatgccatcctctatgagcccggcgagcatcccgatcatgtcgttgtcatcaaggtctgttagctgatctttcacctcgttaaaagttgacatatgcaaggcagatttacattgaaacttgtcactcttttgttgcagtatgtgccgtacgtgggagacagcaagagggctatggacgagtacacctcagagatcttcatgggcggcaagaacaccatcgtgctgcacaacacctgtgaggactcgctcctcgccgcacctatcatccttgatctggtgctcttggctgagctcagcaccaggatccagctgaaagctgagggagaggtaagagccccccaagtgattaacctgaaagcacgctgcacgctaggtgatatagcacttttaataccttctggtgtctctcttatgcaggacaaattccactccttccacccggtggccaccatcctgagctacctcaccaaggcacccctggtaagccttttctcctgcatcccggcatcactgcactgcgttttgcttcaatccagccactgatcgtctctctcgaaacctgaacaacaggttccccctggcacaccggtggtgaacgctctggccaagcagagggcgatgctggagaacatcatgagggcctgcgttgggctggccccagagaacaacatgatcctggagtacaagtgagccaagtggcgtgccctgcagcgcgaggttagctgctggaagggaactagaaaggcgagattagctgtgggattgtgttgggcttgtcgtgttttcttttgcgttctttcctagtcattgctgttgcgcttttgtatttgtcggacccgtaactaccagggctctgctattagcggcacggagcctgtaattgtattgtatgataatgtgatcgagggtgctacttcccctcggcattcctagtgttggttaaaagtcgttcgacagcaacttatcgacccaccactgacttcaccctatccgccggcaacttgtcgaccccattatctgcttagggctagtttggtgagagaattagaacaactccaagaggtcattgaaaaattatttcccaaaccttgttattgggattgttgcaaaaaaattcactaaaaagatctaaacccacagcagactgctaataagtaattcctattttttttgaaacaatctcatcagcagccaagcgtagagggtcatgcagttattttgctcacgtcgtcgtgtggccatgaatgtggtagctgcaacgtgtggttagtgtctctctagtggtcgagctacgcctcgccccggccttctctaccttcgtcgatgtcgcctgcgtcgtcgggagcgaccgcgagtacccgatgatcatcaagcagctgcacgagattgctcttcggtcgctcaagcctctctcgccaccatcgccatttcccaccatcctccaacagaactgtgtgcgaggcaaattaaacgcgggaaccagctacatgcgcacgctgggtgtattggggaacaaatttgtgcacacaaatacgagggagaaaggacagcagatgagggagaaaggacgcctttaaaggcttattcggttaaaggaggattgaatcgattagagtagattaaatctcctcttcaattttaaataaaaggtgatttaacccatcataataccctccaatctccatgcaagcgaagaaagggtaacagatcactatcagttttttccatttgtttgaa

SEQ ID NO: 444 - protein, 510 aa, Zea mays
MFIESFRVESPHVRYGPTEIESEYRYDTTELVHEGKDGASRWVVRPKSVKYNFRTRTAVPKLGVMLVGWGGNNGSTLTAGVIANREGISWATKDKVQQANYYGSLTQASTIRVGSYNGEEIYAPFKSLLPMVNPDDIVFGGWDISNMNLADSMTRAKVLDIDLQKQLRPYMESMVPLPGIYDPDFIAANQGSRANSVIKGTKKEQVEQIIKDIREFKEKNKVDKIVVLWTANTERYSNVCAGLNDTMENLLASVDKNEAEVSPSTLYAIACVMEGVPFINGSPQNTFVPGLIDLAIKNNCLIGGDDFKSGQTKMKSVLVDFLVGAGIKPTSIVSYNHLGNNDGMNLSAPQTFRSKEISKSNVVDDMVSSNAILYEPGEHPDHVVVIKYVPYVGDSKRAMDEYTSEIFMGGKNTIVLHNTCEDSLLAAPIILDLVLLAELSTRIQLKAEGEDKFHSFHPVATILSYLTKAPLVPPGTPVVNALAKQRAMLENIMRACVGLAPENNMILEYK

SEQ ID NO: 445 - DNA, 6830 bp, Zea mays
cgagctagcccaccgtgcttagtttcctgtcggggtccggcccgcttatttgtgccgggctggtccgggcccgtataaatgcgggctggaccgggctcgtaccagaccaaaaaaacatgcttcagaccgagctttcgtgttttctgtacatctatacttataccctctcaattttaaattataaagcatttttaatttttagggtcaaattatgttgatatagtgtacatctaaatgtatagaaaaatggtgaatctaaaagggtcaaattatcttatagtttggaagggagtaatgttaacatcaattatatttttttggtgtttgcccttaaatactacattcaaaaggaaaatgtggtagctttaaaacaaaatgttccaacttaagattttttcttaaaataaaacaatgttctacttcttgaaggaacacattatagtttcactagcaaaatgatgcagctcatgaccaaaacattccatgctaaaaggaaatttataccaccattatgagtaaactttttccaaattctcgagaaaaacattctacaggcacaagaaaaatgttacatatttaatagaaaagtcttatgacatatttatgtgaaatgaaaagattctaagttagttagagcacaacttttaaaagactgacaaaaaaaaattaccactagggcaatgggaaaaaaagcttcaattgtggataaaaaagaaatgatttttatgaggcaggacttataataataaaattaggtacaagcggaataaaaaccgaaaaaaaacgtgtcatggcaatagaatgaaaaaagaacgagagatacaaaaaagagaagtcgtgcgttcacaccctgtttgccgttttctccctttacacgctcgattccccccgccgtttccacgggggccaggtgcctgcattactgggtccgggcctagcgtcagcgcaaccgaacacgccggcgaccgctgccgcccttctcccagctgcccaggtcttcgtcgggccctttgcctgcggcgtcggcgacgagcgcctgccacaccaggtatgcctgccccttctcttcccttctgtgcaaaatgtgcacctgaaccctaatttaacctatttggctatctgtattcggatcagatctgataaccactaggtatgtttatgtattgtgcctactaatagcttgttttttttggcaaaaactatcgggtctacgtgttgtattggctccgccgaactccatgatgcaaaaactaggcatattacaggcttaaatatgatatcggatgcttctagatttatatactagcaaagaagcaaatgctttaatcatgcctagttcaagctttatttgccacaattcagatattttgccaccgtagtcatctgtactgctatgggcaaaaaataaatgtttgctttcatctcctcttttggaaaaccagcgattatgttgatatttcattgggacatataaatacgagtttttttagtttgtaaaaggtacaagggttatactaacactgtacttgattttcttgtaaaaactttgtttttttggatcaatatataaacgatatactcatctgacaggaatcccgttaagtttatttatgctcaccaatttaagggcagaacttacggacctcaagctcttggttactcctgatcttctctaggcgactaggcacaattgccctctggcaaaatgccatcagtttatctttacatccctaacattatcggtacgcctctggatggttatctattgacattctattttgctgttccaaaacctattatataatatttatattttttttgttacttatatctcaaagtctggataattgtactaatgagtaatgattcgtgcaactggaaacattgcctactttctgtcattgattttgtacttcattctagttatgttgccagtttgctatgcagtgcagaagcaacatccacatactgcgttttagttttgttgccactttgctgcccaagtatagctacataaatggaaccataaatttagtagaggacacatagtttaaccaacgagacaatatgtttatctactgcttttagcatgaatgaaaaacagaagcctatgtgactaaaattccaagaattgtcattatcacacagggtattttaggatcatcataaatttcattgcatttgcggtttgctattccaacaaggctctctttgctatcctgtacttcatcaggtgagcgtcttatatctgcaaacttcttgaggttgccaatgatttatgtatattgttctaacatctttacaaacatgctagctttgtccttgatggtgtggatggttggtttgcaaggaagttcaatcaaggtaataattcacattctccctgttttcaagtcatgtagcctgtcattatgtgaagaaggttaatacccatctttgctataatgaaatttccttgcattgtgtgctggagaccaactttcaaatggttatgtgtaaagattgatctcagctaaatctctttttccttttttccacacagtatataagctatctgttaagttataacattatctgatcagtttatttcattctatgaatcagcatcaacctttggagctgtgttagacatggttacagataggtactccttgaatgaatctttaaactctggatatgcagggtgaatacattatagtattctacagactgaaataattttacagctcacattgtttttcttcagggttagcactgcttgtttgttggcccttctctcccagttttacaggtatcaaaagcagaagagcttgtattgatttgtcttgtatctcaatgtctagtacaaatcctaattgcaagcattgttacagacctggtttagtcttcttgatattgcttggattggatattacgagccactggtttcaaatgtacaggtcagtttcctctaccattttgttcagtttttgcaagttcccagtttgttttctagtcagcacctaatcctgttctttaggtagtcaaggcaacagaattaatctgttagcaattacattttcaataattgcctgatggtttcattatgcatgcgttctattcaagagtttctcactttcaattattttttacttatttattagtccttcaattccaaattataagtcttcgtggcttttctagtacatagttttcaccttgtatctagacacaatatatatctagatatgtagcaaaagttatgtacctaaaagccagaaatggagtacttgctaactatgtaatgccatattttctatactagttctttcttgtcaggtaagactagccacaaggatgtaaaacacacaggcaattggcttctgaaattatattatgggtacaggccattcatggccttctgctgtgtttcttgtgaggtatgtcatcgttcatactgtgtgatatcctcaagattgcgatccttgtgcagtttgaattcattccaatgtactccctccattccaaattataagacgtttagcttttctagatgcatttgcttttactatgtattttagcttttctagatgcattgcttttactatgtatctaggatgcaaaattgtaaatgcgtaacaaaagctatgtatctattaagttaaaacgcgaaagggcctctagctgagttggttaggtggtctgagtagcactcctcaggtcctgggttcgactcctcgtgggagcgaatctcaggctgtggttaaaaaaatcccctcgcctgtcccacgccaaagctcgggtctaaggctcagccccagtcgcggtcgttctcacatggacttcgatgccgctgtgtatgggtggggcaggggttcgggggttttctcgacctatgtgagaaggttttcttcttaatataatactcgggggttgtcttaccccccgcaggtcgagttttaataagttagaacatcttgtaatttggaatgtggggagtagaaaattaggggttgaatgttgtattgtggattgaataatgtctcagcacaatcacatccagcaattttttacacagctagcaaaacatgcctttatagttcaccctctaaactatttctttggactaaacttacaggttttatatattttcctgtttctctttgctgatgaggagtcaacaagcttgcttagtgtaagattgcatcatttctatatattgccattccgagttggcatgcgagttatctagcacttgacatttctgtattattaataaacattttaacaggtatgcaaaggcatcctgaaccaaagtcccgtcgttatcttggtgtttgtttccactctagttggctgggcagtgaagcaagccaccaacgtcatccaggtatcggtgcttgaattttcctgcagcttattgcaattgcaatgtacacatttgcacgcatttaacccgaacctggtcattacaacagtatatctaaatagctgggtttagatctgtatatggtgttagaactgttgctgtgctgcatgttctacatggttctcaaaatgcaatttgatagtggatttagtgagaagtctaagattttgtaaaagggtctttaactgagttggttagttggtctgagtaacactcaggttctgagttcggatcccagtaggagcgaattttagactgaggttaaaaaagatcactcgctggttctcctcgttgtgtgcacatccttgttttaaaggcgtcgcctaggcgtccaggcgcccgaaagatccaaggcgtccccgtcgcctaggtaagaagcagcaagagggcatagggcagaggggaagggaaaggggcggcgctgtttcggggtggcagcgccgaatcgggagcggcggaggccaaatccagggcggcggaggctgaatcgttggcggccgcgtccaaatcgtcggcggcgacggcgaatctgaggcggcggcggctcaatcgggggcagcggcagctgaatggtgggggagagaggcaacctagggttgccagaggaaggattatatgggttgactggtgggctgggcctcctaccccttccttctcctttttttttctttttttctttttcttcctcctccatggggctgttttgctgattctcaggttgataaggcgtcgcctagcgtctaggcggtggtccagcgccttatcttgccttaccgccttaagaaccatggtgcacatgagatggaccgacctattagggtggatcctcgtgtagggtatgagagggctcaaagtacaagtaaagatctagcccatagaggttagaccctcatgatacatcggggcaactttcgtgacctttctcggtcgtggttttgattgaacttcttaatataataccggtggggctgtctttccactaccggctggctgagtttttttagaatccggatatttttgacatccatgtattttctgcgtacagatgaaaactgctgcggacgcatgcgtggtgtatgatctgaagcgcagcaaatgaagcatgaaggcagcttcacggtttagtatcgacatatccaagggaaaactctgcgagggggcgggctacgtcttgcgtgccttgacatctttctgatgatgcggtcatatgtgggaccaggggatgacatgccgtggccaatgcaaacaattgttttgtgaaagcagcggccgttaagttgttgtcagtgtgagagtggtgatgcgatcatgatcctttttacctagagtagctcccctttgtgttagcctgaacgatgttttgcaagccgcatgttccgaactctaggattatttggattacaaaacttacatattccatcctcaaggccagttccctcgagagttcgatagttacttatagtcgctggaataggcactagctactgttcgaatgatttcccttttgctccttaagcatcctttgggtcagctttatcgataaaatttctttttttatgtgacatccctttgcttagaaggggattgaatggaataggagaggattgaggaagaaataaactaatttatctctcaatctcttcgaatccctttctaactaaataaactgctttaaatgataaacaatacctctatcctaaaatataataattcgttttagattaattatataccaatggagtttgtatatatatctatattaattatcatttgaatgtatatgaacagaaaaaatgggctagaagtaactatattttaggagaacggaggaagtaccaagttaacattagtttgaagggatataacgcttttcctgctgtgcagctaagagcctgaggccgacggcaatactgtgttgttcatgtgctgcctgcctcgcgcgctgagaccaactatttatgctatgaggacataaaaccgtcctctctcacacagtgccaatcatcacactcgtggattgtgtggtgacgtgtagacaaatatacgtcaagttgcattctcacaactagggtcagatatcgagctagtatggctcggctcatccgaattcgaactagcttgttaaactaacgagcttgctcggctcattaaactaatgagctatagagtcagttcggtttggctcgactcgtttacgagcttgagctagctcgtttagctcgcgataataatcaatttctatttaatttcaaactaatttaacaataaaaaataataattatactcataatttcacataccacatcaatgtaacaccaaattaacataacttatcacttatcaattcacaaacatgttcatcagtttaactcacaattatatttgcatatatcaatttaacacaaaaataattcattaatca

SEQ ID NO: 446 - protein, 215 aa, Zea mays
MPSVYLYIPNIIGYFRIIINFIAFAVCYSNKALFAILYFISFVLDGVDGWFARKFNQASTFGAVLDMVTDRVSTACLLALLSQFYRPGLAFLILLGLDITSHWFQMYSSFLSGKTSHKDVKHTGNWLLKLYYGYRPFMAFCCVSCEVLYIFLFLFADEESTSLLSVCKGILNQSPVVILVFVSTLVGWAVKQATNVIQMKTAADACVVYDLKRSK

SEQ ID NO: 447 - DNA, 3695 bp, Zea mays
aactcggaactcgtctgggcggtctagactccacgcagcgtatagacgacgtggcccattgtgaggatatgactgcaagtctgcagaagccttgggagtccactcttgagccgcgatccagcacgtcgttcttgagttgagcatgaacgtactgcttcccggagctagttcgcggctgttaaaactatacgttccggtgctagaactataaatctgtgtttttttaaaggaaatgacaatcaaagatagaaattttgtcttagtattaaattaataaggtatttatgagagagagagagagaaaacagagagtaggaaggatagtagatgagggaaaaaaggatattctcatacaggtatggaatcatttgattgccgtgatcccgtcactaatttgtttcccgttttgaagctcagatgtcattgagatctaaggtggaacgtctcttcgtctcttgcaatgggacgtggactttggtccaccgacagggggaatatattatatgtaatatagtaatcaaatgcacaaccccccgggtaaaaagggtttatccattgccttcccctttatcgcattaaatctcgattcgactagtcccagtacgaatatgcaagtaaaaccaggatcccgcgaggaaaacgaaagtaaaagcaagatcaccggattggataattagtttcttaatcaggcgccaattagcgagcggaaattgcgaccataaatataaataaacgaggtggcagggcccgccactacagagagagcgtagagacatgttatctcctcacttctcgggccttcctcctggaattccccaaactgccccaccgagaaacttccgtccacggcgtccgggccgtccgatctgtctacgccgcgacacgtgcgcctcagatggaagagcggccgtgcccagcgaccgacgcaaccggggaccattccgccctccggctatctatttaactcgtcgccaacccagggcggaaaccccaatcgcaagctcaagcaaaaacacaaagcgcttaaaccacactcaaaccaaccgccaacaaacaggcctcctagtcccgaccagaacttgctcgtagccccgcccccgagaacccgacagcgcgagatggctcccgagctgatgacagccaagatgaccgccaaggccgcggcggcggcggcggcggtgaagcctgccacgagggcgtacgtgacgttccttgcgggcgacggcgactactggaagggcgtggtggggctggccaagggcctgcgcaaggtccgctcggcctaccccctggtggtggcggtgctgcccgacgtgcccgagtcccaccgccgcatcctcgtctcgcagggctgcgtcgtccgcgagatcgagcccgtgtacccgcctgagaaccagacgcagttcgccatggcgtactacgtcatcaactactccaagctccgcatctgggaggtacgtacgtactgtgtgtgtgtgtgtgttttttgtttactttttagccttttcttttgcccataattgttctgtagcagtgctcacgtcacgtgtcgattcgtgcagttcgtggagtacgagaggatggtgtacctggacgcggacatccaggtgttcgagaacatcgacggcctgttcgagctcgagaaggggtacttctacgcggtgatggactgcttctgcgagaagacgtggagccacaccccgcagtacaggatcggctactgccagcagtgcccggacaaggtggcgtggccagcggcgaccgccgagctgggccctccgccgtcgctctacttcaacgccggcatgttcgtgcacgagcccagcgtggccaccgccaaggcgctcctcgacaccctccgcgtgactccgcccacccccttcgcagagcaggtgagcggtgtgatccatgcgtggcgtgcgtgcgtgcgtgctcactcttcttaattggcacagcatacagcatgtgtgctcactcatctcgatcgaattcctccccccgcaggacttcctgaacatgttcttcagggatcagtacaggccgatccccaacgtgtacaacctcgtgctggccatgctctggaggcaccccgagaacgtgcagctggagaaggtgaaggtcgtgcactactgcgcggcggggtccaagccgtggaggttcacgggcaaggaggcgaacatggacagggaggacatcaacgccctggtgaacaagtggtgggacatctacaacgacgagacgctggacttgaagggcctgccctcgctctcgcccgacgacgacgacgaggtggaggcggtggccaagaagccgcttcgcgcggccctggcggaggccggcacggtcaagtacgtcaccgcgccctcggccgcgtgatcccgtgctctggccttcccccaccgcgcaccgtaccggtggccgcgcgctatagcttgtgtgtgtgtggccatcgcggaacataagaagaatctctcactataaaggccttcgttctgtgtttgcattttggttttggattagggtgtctaatttttcaccagttccttttccccttgtgtaagtgtggagcttactatatagctagcgcccatttcaaggtgctgcaagcgttggtcaggaattgggctagagtgtttgtcctgtaccgagggattatgtgtatttttgctatttcgctcggtaaattaatacaataataaaaaatagggagccgcaaaattatggccatatttctgtcgggttcggtgtcactcgcattactggtgggtgatgttacactgtctttttcatgtttttttttgtcccccccaggccccagatttctttttggacttccttttccttcggttttaaggtggggctcttggctgttgtcatttctttttccggctcgctcttgagagtacactacagtaccctgacgttcccgcacagtgttcacacattgcgctgcgatgcttctgatttggagggtgacgtgggattggtaagggcgtccggatactggaaaatccaccgggatgcggatgacatggctcaaatcttgcacggatctcaaggctgaggcctggcctcaccgaacaatcaaaatcacgaaaatagagtgctgctgttgtcgatttgtcgtggtctctacgctccaccacaacacttcaacagcgtctggcagcaagcccctcacctctcacgggagagagaaagagagctcccggccggcgcgaccagcggtggtccaaagatctagcagcgacgtacggagaaccttgacgcgaggtatcagcgatcagcgaggcaggtgtggaatcagagacaagtgatcgggaacggtagaatcgggcggaatcagggagcaacgagggtggaaggaagagagagcgatggggacgggtatgtgcctgccgagcggaggaagagatttcctctttattttcacgatgggcatggacgtcagtctcaccttaatgccgagagcggctgtaatactatggtcgtttttttctcggtacgattgacaaaccatagcccatagaaaactgcaagttgatgtttggtttgcggaaatatatgttttgtttgccgaagtataacgcaaacggattatataagataatggatattgataattttatttggttaagctctttttagcagtactaggtactactcactccatttttttatttctcgtggtttaa

SEQ ID NO: 448 - protein, 345 aa, Zea mays
MAPELMTAKMTAKAAAAAAAVKPATRAYVTFLAGDGDYWKGVVGLAKGLRKVRSAYPLVVAVLPDVPESHRRILVSQGCVVREIEPVYPPENQTQFAMAYYVINYSKLRIWEFVEYERMVYLDADIQVFENIDGLFELEKGYFYAVMDCFCEKTWSHTPQYRIGYCQQCPDKVAWPAATAELGPPPSLYFNAGMFVHEPSVATAKALLDTLRVTPPTPFAEQDFLNMFFRDQYRPIPNVYNLVLAMLWRHPENVQLEKVKVVHYCAAGSKPWRFTGKEANMDREDINALVNKWWDIYNDETLDLKGLPSLSPDDDDEVEAVAKKPLRAALAEAGTVKYVTAPSAA

SEQ ID NO: 449 - DNA, 2150 bp, Zea mays
tcttttctaatagatactcgaatgaaaaaattcgataccacagtccttgcaactccccttgtcggatccttatcaaaagctcaattttgtactggatcggggcatcctattagtaaacccgtttggactgatttatcagattgggatattcttgatcgttttggtcggatatgtagaaatatttttcattatcatagtggatcttcgaaaaaacagactttgtatcgactaaaatatatacttcgactttcatgtgctagaactttagctcgtaaacataaaagtacggtacgaacttttatgcaacgattgggttcggtatttttagaagaattttttacggaagaagagcaagttttttctttgatgttcaccaaaacaattcacttttctttccatggatcacacagtgagtgtatttggtatttggatattatccgtatcaatgacctggtgaatcctcttactcttaattaatcattagacaaaattaataaactagaaagatcgatatcaagataaaactgccacattttcccattctgaaatgttcccatagtaggtgaatccactgtaagctaattaagaatcctcgaaaattagtggacttcctcttcggaatagaaaattggctatttccacatagggaaagtcgtgtgcaatgaaaaatgcaagcacgatttggggaggggttttttctattgtaacaaggaagaattatctactccatccgactagttccgggttcgagtcccgggcaacccatatggaaaatagaaaagagcaatctgagtttttcatttttactaacttaatttcccaaatttttggattggtaaatgaagttatacgaaaatccaatcgttggggctggcttggttgacattggtatatagactatgttatactgttaaataacaagccttctattatctattttctttctagttaatacgtgtgcttgggagtccttgcaatttgaataaaccaagatcttaccatgactgcaattttagagagacgcgaaagtacaagcctgtggggtcgcttctgcaactggataactagcaccgaaaaccgtctttacattggatggttcggtgttttgatgatccctaccttattgaccgcaacttccgtatttattatcgccttcatcgctgctcctccagtagatattgatggtattcgtgagcctgtttctggttctttactttatggaaacaatattatctctggtgctattattcctacttctgcggcgatagggttgcatttttacccaatttgggaagctgcatctgttgatgaatggttatacaatggcggtccttatgagctaattgttctacacttcttacttggtgtagcttgttatatgggtcgtgagtgggaacttagtttccgtctgggtatgcgcccttggattgctgttgcatattcagctcctgttgcagctgctactgctgttttcttgatttaccctattggtcaaggaagtttctctgatggtatgcctttaggaatatctggtactttcaactttatgattgtattccaggcagagcacaacatccttatgcatccatttcacatgttaggtgtagctggtgtattcggcggttccctattcagtgctatgcatggttcccttgtaacctctagtttgatcagggaaaccactgaaaatgagtctgctaatgagggttacaaatttggtcaggaagaagagacttataatattgtggctgctcacggttattttggtcgattaatcttccaatatgctagtttcaacaattctcgttctttacacttcttcttggctgcttggcctgtagtagggatctggttcactgctttaggtattagtactatggcattcaacctaaatggtttcaatttcaaccaatctgtagttgatagccaaggtcgcgttattaatacttgggctgatatcatcaaccgtgctaatcttggtatggaggtaatgcacgaacgtaatgctcacaacttccctctagacctagctgctcttgaagttccttaccttaatggataaggtttttctcctaaacatataggaatttttgaaggaaggaaagccggaaatacccaatatcttgttccaacaggatattgggtatttc

SEQ ID NO: 450 - protein, 353 aa, Zea mays
MTAILERRESTSLWGRFCNWITSTENRLYIGWFGVLMIPTLLTATSVFIIAFIAAPPVDIDGIREPVSGSLLYGNNIISGAIIPTSAAIGLHFYPIWEAASVDEWLYNGGPYELIVLHFLLGVACYMGREWELSFRLGMRPWIAVAYSAPVAAATAVFLIYPIGQGSFSDGMPLGISGTFNFMIVFQAEHNILMHPFHMLGVAGVFGGSLFSAMHGSLVTSSLIRETTENESANEGYKFGQEEETYNIVAAHGYFGRLIFQYASFNNSRSLHFFLAAWPVVGIWFTALGISTMAFNLNGFNFNQSVVDSQGRVINTWADIINRANLGMEVMHERNAHNFPLDLAALEVPYLNG

SEQ ID NO: 451 - DNA, 3104 bp, Zea mays
catacccatggaaacattttttgttacatagccgtaccctaataggcgaatttcacatgagttgatgggtatcgggttccaattgacatctctacctgccatcatcgtttcgtaaccgtgaaaaagaaacacacgtacgccacgctttgcgtatacttgtagcacgataatgaaccctctgggtgaaaggaccactcgtcggtcggtccacagaccgcttgctgtacgtggctcgtgaagaatttattttgatgaacaaaatgaaatccaacccacgggaggcatgtgttgtgtactccatgcatgcacccgcgccgaaaaagaaagagattcccttctagcccatgccgtctcggccggtggtgggcccctcccccagagcccaaccccaatccgcatgaaacggagcagcatccccggccatatcccgagcgcgcctgcacggccacagaagaaccacgccgcccgagagcaaccgccgctgcaaaagcgaatccgtcccaattcagctgaggtcggccgtgacgccaaccccgcggtcccgtccaatccaatcctgggccgctgaggtggccatccacgggcctccctccctcccccccaccttccccgaaggcccgaacccaccaggccaccacctcatccagctgcccccgcccaaccacacgtgccaattccgctttcgcgcagccgccgactcgctttgacccccatcccgcatcccctatccccgaggaagcttccagaccgcccgcgcccgccgctatatatccctctcctgcgcgcggttctcagcttcgacaacaccgcgcgcgcaatacacgggacacacacgcagatccgagctaaccaccatcgacgagcgccagccgccagcagccgagccggagcgaccttttcttttttcttttacacagcgggacggagaaaggagtcaatcagccaaagccacccaccgcttttacccaccgatcggcgttgccgccgctagcattgtcggcttcagctccatccaaatccaccgccagcaagcaagcaagcaagccggcgccatgggtctgccgatgaggagggagagggacgcggaggcggagctgaacctgccgccggggttccggttccaccccaccgacgacgagctggtggagcactacctgtgccgcaaggcggcggggcagcgcctccccgtgcccatcatcgccgaggtggacctgtacaggttcgacccctgggacctgccggagcgcgcgctcttcggggcccgcgagtggtacttcttcacgcccagggaccgcaagtaccccaacggctcccgccccaaccgcgccgccggcaacgggtactggaaggccaccggcgccgacaagcccgtcgcgccgcgcggccgcacgctcgggatcaagaaggcgctcgtcttctacgccggcaaggcgccgcgcggggtcaagacggactggatcatgcacgagtacaggctcgccgacgccggccgcgccgccgccgccaagaaggggtcgcttagggtaagcccatctttttgtcggaattgaagacgggtccgttttaatttgatctgcgctggacgaatttagctaatagtctgatcgaattgaatcgtcgtgcagttggatgactgggtgctgtgccggctgtacaacaagaagaacgagtgggagaagatgcagctggggaagaccgccgtcgccggcgtcggcgccaccaaggaggaggcgatggacatggccacctcgcacacgcactcccactcccaatcacactcgcactcgtggggcgagacgcgcacgccagagtcggagatcgtggacaacgacccgttcccggagctggactcgttcccggcgttccaggacccggcgatgatgatgacggtgcccaaggaggagcaggtggacggctgcagcgccaagagcggcaacctgttcgtggacctcagctacgacgacatccagggcatgtacagcggcctcgacatgctgccgccgcccggggaggacttctactcctcgctcttcgcgtctcccagggtcaaggggaaccagcccgccggagccgccgggttgggacagttctgagctgaggcgaggatggagccatggatcaggagatgaagacggttgcgaactctgtaaatacagcataggagtcgaacctgaccctgacccttgttggggttacaaggttttccgagtgtcggtgtagcgtacatggagccggcggcgcggccgggccggctcattctttagtttcacttccaaagcagacgggtagatatatgtgtagctgttcacttaaactctcttcgacagaacaaccgacgaaattttgctcttgtttataagtactacctcgactgtcgcttccctttgtctgtctcttccctaccctgtgttgtatacttgtattggcatgcttgcagcgaccacggggacagcggcgggctcaggcctagatgtgtcaacagagatccgatacccgataattttcgaagattttaatctccatgtacagatctggaagaaattcttctccattggatatgaatatgtgtacgaagattttaatccctgagtacaaatttgggagattcttccgtattggatatataagtatggtatgaaaaaacagaactctgaacctaattgtccacggataatattcacacagtaataaaattaggtgtgtatctttataggaaacaagcctaacaactaaccctaactctctcaaccttttaagctaagcacctatataatatgattatgcttttttattggggataaggacgtattgaagatccaatacccgaatgggtatgtatgtaagatgaattatgtgcctatgatgggtatggatatggggatgatgatacctatagcttcatagggatgattacgaggtgcctaaacccgatggagaattcttcattaatatatctacttaggctatatttacttaggctctctccactttgtactttgtaatacaacgctatgtaaattacgattccgtaggaggtcgctaaggtcatctctggattccgtaggaggtcgctaaggtcatctctagcagagcttatatatagg

SEQ ID NO: 452 - protein, 312 aa, Zea mays
MGLPMRRERDAEAELNLPPGFRFHPTDDELVEHYLCRKAAGQRLPVPIIAEVDLYRFDPWDLPERALFGAREWYFFTPRDRKYPNGSRPNRAAGNGYWKATGADKPVAPRGRTLGIKKALVFYAGKAPRGVKTDWIMHEYRLADAGRAAAAKKGSLRLDDWVLCRLYNKKNEWEKMQLGKTAVAGVGATKEEAMDMATSHTHSHSQSHSHSWGETRTPESEIVDNDPFPELDSFPAFQDPAMMMTVPKEEQVDGCSAKSGNLFVDLSYDDIQGMYSGLDMLPPPGEDFYSSLFASPRVKGNQPAGAAGLGQF

SEQ ID NO: 453 - DNA, 4823 bp, Zea mays
tctgccttggcaaaggttggattccgaaagatgcgattgcaattaccagaatgtgtgaacagtaaaagaatactgttcactatttataggcacaggacacagcctgtgaggaattacaattatacccctcataaaagtttacaacattgactcagacctttatggactaaagggtcattttatctttaagtcggtttgtgataccgaagcttcatgaagaggaaccttcggccatctcatacaaacagcttcagccgagagccacttcttcctagaagaccttcggcgacgaagcatagacccaacaccctctttacattgtacttcccacgtttcaaaatataattcgttttaaactaattatatattcattaaataacataagaatatagtttccatgtatgtctatattcattatcatttgaatgaatatggatagaaaaaaagtgggctagaaacaactgtatttgaaacggatggaggcttttttctgatttttttcctctgtatacatataaatttcgttcacagttcctacgaaattcgtagcgtttcaaacggggcaaatctgaaacactcatattggggcaaagtgagggcccattgattttctttcctcttccacgtagctccgcaactgatctttttacgagtataacgctcttcaaaattaaattgagatatggatgacctgcatttcttttcggaactgtacctgtcatagacgggaaacctaccaccatgtttccatcaatacaccagaggaactgacaccgggtcccgctgacaggtaagccggcagaggccctacatggcagcaacctagcaccaggtgctcttctcccggggtcgaagatatttttgtacgtatgctaacaatctaacatcccaacaaccgacggaggcaagccccccacgtggcgacatatggttggctgctcgtcgcgtgctcggagaccacgacctgtgacttgtgagcgtatccagattatataatctaaaatattattaactaacattctctaagtgttagtttaaaatttgttaatgtttttaactaacatttcctaagtgttagtttaaattttttttggtgctgagctgagacagggacaggcaagcaggaggaaggggatggagtggcgccgttagcgaggcaaggttcagtctactcgttgacgttcgacagatcccagagcaccctcggcggggccgccgccagctgtggcggtagccgtggcatccccaagggtttcggctccgtgaacatggacgagctgctccggagcatctggaccgcagaggagacccaggccaaggcctccgcctctatcgcaggagcgagcgcggggatgccccccacgccgatgcagcggcagggatcgtcgctcacactgccccgcatgctcagcaccaagacggtcgacgaggcgtggagaaatctcgtgcgcgacgaaccgccgcagggggcggacggcggcggacaccagccgccccaccgccagtcaacgctcggggagatgactctggaggagttcttggtcagagctggcgcggtcaaggagaaccccgcttctgctcctccagcgccgccacccatggtgccgccgcggccggtacctgttgcccctaaaagctccgccttttttggggatttaccgggtgccgacgacgacgcagctacggcagcggtagggtttgcaccggtcggcatggtggatctggccctgataccgcccagggcggcaggcatgggaggcagcgccatggctgtgcaaacagcggtgagccagcttgattctgtcgggaagggatacagcgacctgtcgtcgctgacggagccgcaaactttttcgtttgaaagaatgattcgggggagaaggcatggaggcggagtggagaaagtggtggagaggcggcggcggaggatgatcaagaacagggagtccgccgcgaggtcccgagcgcgcaaacaggtcacagccttttgctgaattcatgcatgtcttactgaccaaggcaccaagcaatttgttagtgcttcttgactcatgacattgtgaactttcgcaattcgattataatcagagtcatcgtactcttcctggttactgtgttaccgttcttttaaagcagacaaattttccactttgctgtttcggttaaaaagaatcttattttactgcataggcttatacaatggagttagaagccgaagttcagaaactcagagagcagaatcaggaactggagaggaaacaggtgtcttttctacaattttctctacacacttctagatttgcttcttctttgggatttggtgcattgcctctcgacgagcatttatttttagtcattctgaaatagatagtttcagcatgctccatgttgcctgcatcaattgtattcccctgaatcattcactatctacttcactcctgtatttttcactgcatttccagaatgaaaaaggtgcaccctgtatatttctggatatcaataattgccttgcgccacacttcatggaccatgtttttaagtgaacattaccaaagaaggggcacggcaacagttcgtcagcatataaatagatttgacgtccggatcacatttcgtgtagcttacaatgagactcgttcatccggatcacatttcgcgtagttacagtgatactgcgtccataggctagtgctaaacacttttagggataggcacacatccttgcacctcagactgttctttggatgtgctcatagtactgactactgatcattcatttcttcgtaatgcaggcagaaattatggaaatgcagaacaacgaggtaactgttaattcaaatatactctattaatctcgcgttgtgagttgctagctgagcaaccagtcgctaaattggttgtaggattcagttaggggaatcatacttccagagtttctctctattccacacatctagttcaacttagcttcagatatactgcatcatccttgtacactgctcagcctgtgagttcatcatatcgattatgattgtctgttactcaacaaactatacttttcattattcaaagaaaagaaatcgaattaggtttttaagagagctggctttgatacatgtgtgttagctcaatcccctgagggctccatgagtgtatgcacggctagctcgttattactggggttttttggagttcttcctcttacctcgtttaaaaaaaattactgacagaatctggagcagtttacaaatgtacggcattgcttccagcacatataattttattttttttcataatgacccgcctgtttttgcatttggtaacgatgactgcaaattttggcgacaggtatcagaaatgttgaaggatccattcggacggaagaaacggctgtgcttgcgaagaacgttgacggccccctggtgacgattgcctagaacagcacatgacttgcacttgctacgtacctgcaggggcgtttgggatctgtagataatttctctcctatagtgtagcgatgaacccatgaacatgaacataatctaaatgattgtactgttagctcccttctgccgcttacgtagtactggagtaccgtattggtggagtcgaaaactgacatgtaaattatgtacgtagtagagaacaaaatggagtgaagccggtcgcaagagttgtggcttcagtcatcctccagagcttgtgcagagttgcctaggttttgcatcttgctggcacatccagactccagagcttgtgcagagttgtctaggttttgccatcttccagagcttgtgcagagaatgaatgattttaaaagatccatgactgggtatggattgatgggcaacaaacatggcagggttcaggaaatgattcaccgttaaaacaaccttctcctagcatgtcttagaaaaacatgcgatatccactataacattaactagatcgttaatagtgtagttcttccttttggcaatcccatgcgatgggacaaggggaagagttctttcatgtatgactatattttcggcatgaaagtaggagaaattatttgagaaatacttagcaccatatgaccttaactttttaatcctcatgtctaattgattctcgacctcagccttatagattctaaagtaatctaatccaatatatttattttttggtaagtacacataacaatatctagttacattatcgatagaagtcatcatgtacttctttcctcctttagtaaatacaccattcattttacaaagattagaatgtacgggttctaaaagtgttaaaccttttcctccacaccaaagtgaggttttcttggttacttagtttgcacacaaacttgatgcttcgaacctttgaccataggcagtttaagaattaaacataaggcagatagtcaagagatgtttaaaaaattatttgtaatcacattttattttctatacggagtatctgttatttaatatatcgaattaataagtcaattttataattatttttattaatttatttaaaatacattttaattaatttattttttgttacacttagatatttttttaatctcattttagtttaaatttgtcgcggctctttaataatgtatcgaatttggataaacaacaaaaagtatggtctaagcacggtcgcgtgattaataagaaattttcagcttgttcgctgcggcttgctgcggctgcaatccggctgcggctgcggcttctacagtatttttctctctatggattgcagctgcagcaatccaaacagctgcaacagtgtcggcttgtagccagccgaacacgccctttgta

SEQ ID NO: 454 - protein, 295 aa, Zea mays
MDELLRSIWTAEETQAKASASIAGASAGMPPTPMQRQGSSLTLPRMLSTKTVDEAWRNLVRDEPPQGADGGGHQPPHRQSTLGEMTLEEFLVRAGAVKENPASAPPAPPPMVPPRPVPVAPKSSAFFGDLPGADDDAATAAVGFAPVGMVDLALIPPRAAGMGGSAMAVQTAVSQLDSVGKGYSDLSSLTEPQTFSFERMIRGRRHGGGVEKVVERRRRRMIKNRESAARSRARKQAYTMELEAEVQKLREQNQELERKQAEIMEMQNNEVSEMLKDPFGRKKRLCLRRTLTAPW

SEQ ID NO: 455 - DNA, 4402 bp, Zea mays
gaaatcgaaacaagtgaagtgcgtccagtgcgccatgaccgaaaaaacctcgtcaccgatcacacgctcgagcaatccaaaaaacaaaacaaaaaaaaaaaggcactgaacgggaggacacgcttctagcatcactacgtttttttcctcgtcatcatcgtctgtttcttcttccgggtggttcgtgatcacgcgcttttctttttaacaactagtactaagaatctaagataagggaacaaaacatgaccaacgcaaaaaccggggggggggggggggggggggcaagaattcgcaacgacacgactacacgaggccaggccaatggagcgtccaagctactgtaggagtcccagctttcgcggcgcgtcgttttcgttaggccgtagggggacggatttcgggatttgaaaacctgggcatattctgcgtccagaggattcgctggggatttggggggaggttagaatatgcggccgggtgcttgctagtactgaacaaaaaacaaagggcaccgaaagccgcggtcgcctttctcgcaccggcgccgggttgagatgagaacgactcgggtcgctgttctgcggaaatgggggcgcaggatatcgtgtggttgctggaaaaaaaacatgtgctgggctcgacgatatttttacccctcgacgacctcgaaggatgctgctatagctcctcttggccatagaacaggagcaggagtgcatgcagagctcctgcgccggccggcgagcatgaggaactgaggatggatggtaggcatatgtgaggaacatgtgttcggttcggtgacggtgacgccagccccggcccttgcctgtctgcctacgcaggagcctacctgcttcatccggctctggttcgtccatctgttcaacctggcttcatgggcgcgtgacctgagcttaaccaccgcctcgtttccgcggtagggtttactagctggtgtccgttgctcggctagcaccgtagcacgcacgtatctccagcacacggtgacaaaaaggaaagctgcagcgagcattttcaggcaacagtggtaactattagtagtattattctctcatgcgatcaacatacatagtggctgtatggatggttaaccatggttgcctcttgaccgcactaccggcgtggcgtgacctaacctaacccgagctccctccctttcgcccccctgtctccctcgcccacgcacgccctttattaaggcacagaggacagcacacagtattgtgggaactgcatgctgagagcaaacccagaaaggaaaaaggaaaaaaagaaaacagagagaggggagagtgggagacggtcggagacagaggcctcactcctccacactctcagtcgtcttccagtcccagcgctttcttggatcgcgaggaaaccactcggggagtttgcagttgcagagaactgtatcggccgaagtggttgcacggtgtgttggccttggccatgcgccacggcagggaacagagacgagcagcagggaggcagcaatggaggcgctcattgaccctgctctcgctgtaaagatagtcccgcggtgccctccgaattccacttgatccaactctcgacatgaagcggccacgcggcgctactccctccctgtctgcgatgcccaatcatcaggaaggtaacttccagcctcatctgttttattcccctttgcaggaatccattgttctggccttctctgggggtgggtgatgtcgtggcgggaatgcgtgcggaatgaagatctgagtccttgtgcgtgcgtgttcccagatgacggctacggcgtgctcgggatggaggcggacgtggacgtggacgtggacgaggagatgatggcgttcggcggcggcggcggcggggagaagaagcggcgcctgagcgccgagcaggtgcgcgcgctggagcggagcttcgaggtggagaacaagctggagccggagcgcaaggcgcggctggcgcgcgacctcggcctgcagccccgccaggtcgccgtctggttccagaaccgccgcgcccgctggaagaccaagcagctggagcgcgactacgccgcgctgcgccgctcctacgacgcgcttcggctcgaccacgacgcgctccgccgcgacaaggacgccctcctcgccgaggtagtattgtcgataactccatactatatatgccgtcgtatcgtataggctgctgggcgagtacggttaaggcgttctatcgtttcttcgcgtgcgcaacggctgatcctagttccgttggctgtgtgaatcgtcgcagatcagggagctcaaggcgaagctgggggacgacgaggacgcagcggcgagcttcacgtcggtcaaggcggagccggcggcctcggacgggccggcccccgcgggggtggggtcgtccgagatcagtgactccagcgcggtgctgaacgacgcggacccgcccgtggcggaggcgccggcgccggcgcccgaggtgcagggcacccttcttgtcgcgccggctggccccgttgccggcgcagcggcggcgaaccatggcggggtgttcttccacgggagtttcctgaaggtggaggaggacgagacgggccttttagacgacgacgggccgtgcggcgggttcttcgccgtggagcagccgccggcgatggcgtggtggaacgagcccgcggaacactggaactgaaccgaggtggacgcggcagtgcagcgtagtagaatcgggatctcggacgagcggtggaggaataaccgaatagaggaattcggagcgataaagaaggggcttttctgcaaattttgtaaaacggggttttacctagccctactttttgtcaattctcgagcgtattagcagtagacagtagtagtagtctgggtcggaacccagtcaagctcagcgcctgggttgcgtttggactccagtgcagaattgcgtagaggatttagaggaagagcggagctgagctgagcgaggcaggagtaaaggacaacctgtatgtcactgttagtgggcccagtgccacgtgaaagtcaggcactgttggtgcccattgacggccggacttgccagcgacgcggatgggcgacgtgaacgtgtctggccgagcagtgcgctcgctccctccccccaatgggccatggcctcttccgcgaaagcgtgctcccctgtaagtatctgatttggatgctagccaaggctgctggatgattacttcgattatctaaaaaatctgatttggatgctcgccgctagatcgttggctcgctgcggagggaatcggcagcggtgccgtcagattgtggaatgtgttcaacggttatctgttggattaatgtgggcttggcccaaattaatattcaataatagtcaatgctaatggcccactttaatgctatggtgtactaattatttagtaccatattggaagttcaaaggacaaatcaatcaacttaaataggtggaccattggtgcatctattgagaagttgagaaaaggatgaaggactgccacacgcgcgcgcgcgcgccgccgccgccgtcggccgggccgggccgtggccgtggccgtggccgaccgtcataataaccgtctgtttcctgtcttatggctagtaacggacgtcagttactggcgtcagtttccagctctaatgcgcgaccgtttctgtccgttgtccttctcccttcttctgaccgcctataagaatggagatggagggctcttccagttaggcgaatcatctcacgcgaattgcaaacaacacattcccgtcccatcttctgcgagcacagagagagtgggagagcaggcctccgaaatcaccgaccgtagagatacacttgcacgggtgtgcgggcgatcagatttttggggagcgtcttcgcgactgctcgcgtgatcgtccactgccttgctgttcgtcgccttcccaagttgacgcgtgctgctgttcttcttcccggcgaccgttcgagggactgcactgcgtacatcttcctgcaccgacttcgtacggctacatcgaacaaacacacgagatgtctcgtgtgaatggagccactggtgccttgagcatcggtccctccgctgggtacactctgttcttcgtatttatgcatgtttcattgctgtttactgcttatgcgagtagttatacacacatgcatatacatgtcattacatatatcgcactgattatctggattaaattaaaactaaaaatgcctaactttctaacagtccaaaaatctgatattaggcatttttctgttagtggttttgctgctgcgttaaaaccaagtgaaccttttgatgggacgttttacaagagatggcgtagtaagatgatactgtggttgaccgcaatgaactgctatcacgccgcac

SEQ ID NO: 456 - protein, 273 aa, Zea mays
MKRPRGATPSLSAMPNHQEDDGYGVLGMEADVDVDVDEEMMAFGGGGGGEKKRRLSAEQVRALERSFEVENKLEPERKARLARDLGLQPRQVAVWFQNRRARWKTKQLERDYAALRRSYDALRLDHDALRRDKDALLAEIRELKAKLGDDEDAAASFTSVKAEPAASDGPAPAGVGSSEISDSSAVLNDADPPVAEAPAPAPEVQGTLLVAPAGPVAGAAAANHGGVFFHGSFLKVEEDETGLLDDDGPCGGFFAVEQPPAMAWWNEPAEHWN

SEQ ID NO: 457 - DNA, 4075 bp, Zea mays
ttttacaatgtttattgaaagtttattacgaaggttcaacttcgtaataatactctcttcaaccttcgtccaagacccattatcctcaaaggaataatgcttcacggacgaaggacagtatcatttaacattttatgttgccttgttcttaattcatagcatttgagaacaagtccccaacaaaagtgtatttcaccaacggttccaaaataatcactagtggaaatgttgatttccattgggccctagtaccggcggtgctaaaaaacgataatgtaaatcggtttagaaccaccactttagagctttctgtactattgaaaatctgtagaatagtaaatatagtatcacgaaattgtagattgaatatcaggcaaaatctgaacggtgttgttgctatgtactcctcacatggcgacggacagtgacatcctatagggctagcgtatgctgtggtccgctccgtacgtggacgtgttgggggaggtggctgcacgttttcggttttcttgtctacttcgtacgtgatccctagctaccacaataaaggtggagcatatatattttcttggtttttagggttaattgtggtcggccgagtaccacctgtcccagatgatattacatgctgcgaattcacctatatatatatatatatatatatatatatatatatatatatattatatatatatatatatatatatatatatatatatatatatatatatatatatatatatatatatatatatatatatatatatatatatataagaaggaacacgtatggtagatgattccagatgcttaccatgcatgttatcatagagttaaaatgtctgtgtcgcgtaacatttctgaaaataatttcggaagatgaagataatgtttctgttacgtaattttccgtcccttgttgttcacatgtgcgtacccacgtgtcagagtgagagatgtaccagtataaagaagcgcagagcccccaagagccggagctgccatgaggcccgaacagttgaagctactagcgtgtagctagggaagagaagcgcgcgagtagctagcagacgtacgtaggcagaagcctagctgggtttgaagggccccgatcgatgatcccctacgcgactgcggcggaggcggagggagcactggggcgcaccatgacgtgggctgagacagcatggtacgagtactcggcggtgatgccagattcctggctgcactgccacaccacatttatcctgttcgtcatctacagcatcgccccgctgcccctgctactcctagagcagttcgctccgtccgtcgtgctgccgtacaagctgcagccccgggtacggctgcccccggcagcctccctcagctgctacatggacgcggcctgcatctttccgctcgccgttggccttcagttcgtctcctatcctgcggtcgccaaggtcttgtcttgtgtattttaatatcatgcatgcatgcatgtgcatcaatattatcactagcaaagaaagaaagcatgccgttgatgacgtacgatgcctatatttaccagatactaaggacccgaatgggactgccgttgccgtcggtgagggagaccatcgcgcagctagtcgtatactctctagtggaggattacctcagctactggatgcaccgtctgctgcacacccagtggtgctacgagaagatccaccgcgtccaccacgagttcacggctcctacaggcttcgccatgtcgtacagccactgggccgagaacgtcgtcctttctatcccggccttggccggcccagtgctcgtgccatgccatgtcaccacgcagtggctatggttctccatccgcctaattgagggcattaacacgcacagcgggtgatcatcattacatgctctgcacagttccaacgacgtaaacacaacaagagtgcatccaattaattaatatattcatcttgttgaaatttgcagttaccatttcccgttcagcccttgcaggctgattccattctacggaggggctgcataccatgactaccatcactatgcaggaggccgtagccaaagcaactttgcacccctgttcacctactgtgattatttatataggacagacaaagtaagtacatgcttgcttagcttaattatatactgtgttaacacatatactctctatattcttttttatttgtcgtgtttcagtaaaaaatgaactaaatattcggagatagtaataatttatatagggcagacaaagtaagttctacaaacctcggacaacaacctgtatttaattttaacatgcaataaatatgccacaacagcacaaactagctagctagaggcgaaatagacatgtcggggctcacatttgtgatccgttggttttcgccatacatgcgccaggtgtccgtgacataaagctgccaaataagaaagagatagcgatgtgttaccaaatgaaacaaggagacacatgataaagtaataatattatatgcatatgagaatttcgttctgagaaataaatgtacatttatatggtttgtcatgtaaatccacgaataggatttattatatgtacgtatatttgccaatccttagcccacaatgactatatacatacttgcctttttcagggctacagataccacaagctaaagcaagagaaggtatcagcgtatctttacatatttgccttttatataaatgtttttgttctcttctgattgatttataatcactacggcacagctgaagagtctagcagaaaatagtgcggataaaggaggcaactactcattcgacgaagggaaaaagaacagatatttttgtgcctgagcgtacgaagaataatcaaggctattacttcgtcctgttcgaagggaagatttgcaaataaataattcgaatttactgcagaagctcttgattggtcgacgaacaaatatattgttgcaatccgtttcgtgtattctatatatctaatatgaaacttttttgtcggaatatatggatcatcccgatacattactttataagtaatgaataccacataagtttttgttggaagatggtctatttaagcttatttgtggctggctcaattcattttaaaaactcaaagggtaagcacacatgacatggttgccacattgcttatctagggtagatgacaaccaacacataaaaatggggtgtgcatgatccttcacatgtaaaaaacaagtcttatggagaccgcactagacacaccacgcttgtttctctatgttattaccgcgtgactgtgccacctagcttgacctgtctgatgggctttgccacctggcatgacctgttagatgaatcactctgcacactgattgactcccttaaattgattcatgaatcattttgctagaggtggctgtcgtgcctctaagtgctagaggctgccaatttccaagcgttccacctagcttgaactatctgatcggctctgctacctcatggattgacctgtttgatgaatcactctgcacactaatcggctcccttgagctgaacgtcctcttttctgagtcacctaaaacaggtacataaatgtgcgttgaaagcgatcggaaagggatcattgttactagatcgatgcatgtcgtccgcacatccaaaggatcctcctcttttctgagtcacctaaagaaagtaaataaacatgcattgaaagcaaccgaaaaaggatcatttttcctagattaacacatgtcatgcacaagtctaaagaaccgtcctcttttctaagtcacctaaaacaggtaataaatgtgcatgaaagtgacaaaaaggatcattgttcttataccgatgcatgccatgcacacgtccaaaggactatcctcttttcttactcacctaaaacaagtaaataaacgtgcattgaaaacgaccaaaaagggatcattcgtcttaaatggacgcatgtcatgcatatgtccaaatgactgcccatgctatatgtcaaatccaaggccatataatataaatggtaatcatagaaacattctagatccaatctatagaatatatcata

SEQ ID NO: 458 - protein, 306 aa, Zea mays
MIPYATAAEAEGALGRTMTWAETAWYEYSAVMPDSWLHCHTTFILFVIYSIAPLPLLLLEQFAPSVVLPYKLQPRVRLPPAASLSCYMDAACIFPLAVGLQFVSYPAVAKILRTRMGLPLPSVRETIAQLVVYSLVEDYLSYWMHRLLHTQWCYEKIHRVHHEFTAPTGFAMSYSHWAENVVLSIPALAGPVLVPCHVTTQWLWFSIRLIEGINTHSGYHFPFSPCRLIPFYGGAAYHDYHHYAGGRSQSNFAPLFTYCDYLYRTDKGYRYHKLKQEKLKSLAENSADKGGNYSFDEGKKNRYFCA

SEQ ID NO: 459 - DNA, 3776 bp, Zea mays
acacacgttagtcatataatattacgttgtcattaatctctatcgatatttttcacccattacgttgtcactagatgctttcacccatttcgatttcagacgatgtcttcggacgttgcgggccatgtgtccaaacgtggttaagtgtggtcgggaaatacccgatcgaggttgagttcggccttcgctccgacacccagccgtgtcattactgtcatatatattgtagcaatgtcaaaaaaaatcaaaacattgagtatgacgtatagggcacatatgtcattaaacttattcagtgtaatgatatattatcatcacgggacttttttttaatgtatgtattagattacctctgccatgcactatacaaacagctacgccgcagtcgcaagcaaacaggctctaaaaggcttcagtcggagaaggatatgagagcggtgagtaccaaacgggtatcttccccttccaaatgatataagcctacttgtttgaccccagcccgcaggcagtcatctgctataataggctaatacaacttgtgtactctagtctgctctcgccgcgttgtccgcatgctgaacccgcgatgttaacacctccctgaacgagtcctctgttcctcaactgaaattcagcaataaaaggaaaaatccgcggtccctgtccctgtccagcaccgcactctcgcacttgtgctgcaggcttctgagctcggcacctgctgctagctgctgctatatatagacgcgttttggggtcaccaaaaccaccagctgatcaacagctagcttcattcctctgcctctctctccctccttcgccaactggccatctctgttgtctctcgctagctagctcgctcgctcgctcgccagtcaccacacacacacacacacactgtgtgtctgtgcctgacgccgccccccagtttcaaacgaacgacccagccagaaacgcgcgcgcgccaaagctacgtgagtgacgtggcagcatggtgagcatgatcgccgacgagaagccgcagccgcagctgctgtccaagaaggccgcctgcaacagccacggccaggactcgtcctacttcctggggtgggaggagtatgagaaaaacccatacgaccccgtcgccaaccccggcggcatcatccagatgggcctcgccgagaaccagctgtccttcgacctgctggaggcgtggctggaggccaacccggacgcgctcggcctccgccggggaggcgcctctgtattccgcgagctcgcgctcttccaggactaccacggcatgccggccttcaagaatgtgagtgcctgctagcttactcattcccaggcaggcaggcagccagccacggcatgccgaaccagtctgacctctctcgcgcacatgaatgcgtgattcccgcaggcattggcgaggttcatgtcggagcaacgtgggtaccgggtgaccttcgaccccagcaacatcgtgctcaccgccggagccacctcggccaacgaggccctcatgttctgcctcgccgaccacggagacgcctttctcatccccacgccatactacccagggtatgtgtgtgtgttgccttgtacttactcgtcgccgcaagtacttgcagtagggaacgtgcaagtggcggcggggcggcgtctgggtgtcgccgcgatgcacgttactgctattaaagtagtagtagtacactaatagctaggcccaccacagcacacgatgacatgacgaacgatggatgggaacggctgctgactgggcctgcttgctcttgtctgcaggttcgaccgtgacctcaagtggcgcaccggcgcggagatcgtccccgtgcactgcacgagcggcaacggcttccggctgacgcgcgccgcgctggacgacgcgtaccggcgcgcgcagaagctgcggctgcgcgtcaagggcgtgctcatcaccaacccttccaacccgctgggcaccacgtcgccgcgcgccgacctggagatgctggtggacttcgtggccgccaagggcatccacctggtgagcgacgagatatactcgggcacggtcttcgcggacccgggcttcgtgagcgtcctcgaggtggtggccgcgcgcgccgccacggacgacggcgtcgtcggcgttgggccgctgtcggaccgcgtgcacgtggtgtacagcctgtccaaggacctgggcctcccggggttccgcgtgggcgccatctactcgtccaacgccggcgtggtctccgcggccaccaagatgtcgagcttcggcctggtgtcgtcccagacgcagcacctcctggcgtcgctcctgggcgacagggacttcacgcggaggtacatcgcggagaacacgcggcggatcagggagcggcgcgagcagctggcggagggcctggcggccgtgggcatcgagtgcctggagagcaacgcggggctcttctgctgggtcaacatgcggcgcctgatgcggagccggtcgttcgagggcgagatggagctgtggaagaaggtggtcttcgaggtggggctcaacatctccccgggctcctcctgccactgccgggagcccggctggttccgcgtctgcttcgccaacatgtccgccaagacgctcgacgtcgcgctccagcgcctgggcgccttcgcggaggccgccaccgcggggcgccgcgtgcttgcccccgccaggagcatcagcctcccggtccgcttcagctgggctaaccgcctcaccccgggctccgccgccgaccggaaggccgagcggtagccggtccccgtccgcgccgaccgcacgtgctcagctcagcagcttcacagctcaccaccagtcaccaccaccaccaccaccaccacctggggtggaggcgtggagcaagcaatgttcatagaaaccacggtcacgtactatacaatactactaccgtaccacaccacacggcagcatcattagcagtaggagattagtagtaatcattaattccttattgggttcttgtaatttcgtatataccacgccgccatttttccttggggccaggccagccgataggtgcccgagggccactgcactgcactgctgtattaggtaggagcaggagtggtgggtagcgaatccaccttccagcagcaggcatcacatttgtgtatttttcgactgggtctcccggttgttttgggtcactctgtatcattgttacgacgattgtattactgctcggtaaataaatttcacatctgaaaacgttataaagtggactctcacgccctctggacgcttctgtagcctttgctacttgggagttcgccggaccggtcggcagtcggcacttgcggcagccggcaggcatcgcgtcgccatcacgtgacaaaaaaaagtcaaacccgccggaaccccatcgtttttcaacgctctgggacgccgataacaagcctctaggcttcatgtgacataaacgtacttactgtattgctcggttttaggcctaagacgtagatttaccagtacacccacatataaacgaaacttcttgtcttacagaacttttattgaacagtaagatataagggttagatacattttattatacctatttatgtcttagctatatcttctattaaaaaaaaaccgcactacagtgtcgctacggggacttgctgaaaccatgtgtgtttggttgtaatgacagaacgagatgtaatatgacaatctcttaaataaaattgtttggttcagggtcagggttggacaggactatcacagtgttatc

SEQ ID NO: 460 - protein, 482 aa, Zea mays
MIADEKPQPQLLSKKAACNSHGQDSSYFLGWEEYEKNPYDPVANPGGIIQMGLAENQLSFDLLEAWLEANPDALGLRRGGASVFRELALFQDYHGMPAFKNALARFMSEQRGYRVTFDPSNIVLTAGATSANEALMFCLADHGDAFLIPTPYYPGFDRDLKWRTGAEIVPVHCTSGNGFRLTRAALDDAYRRAQKLRLRVKGVLITNPSNPLGTTSPRADLEMLVDFVAAKGIHLVSDEIYSGTVFADPGFVSVLEVVAARAATDDGVVGVGPLSDRVHVVYSLSKDLGLPGFRVGAIYSSNAGVVSAATKMSSFGLVSSQTQHLLASLLGDRDFTRRYIAENTRRIRERREQLAEGLAAVGIECLESNAGLFCWVNMRRLMRSRSFEGEMELWKKVVFEVGLNISPGSSCHCREPGWFRVCFANMSAKTLDVALQRLGAFAEAATAGRRVLAPARSISLPVRFSWANRLTPGSAADRKAER

SEQ ID NO: 461 - DNA, 2667 bp, Zea mays
ttgcactgtttgtacagtgaagttttaaataaagagtaagataggaagtgagataaagagtattctggagatagtcttatacatcaccgtagcaacgcatgaatatatacctagttaatattatatgatttaaattttatcttaaaatacttgacgctctatgagtttagtagtttataatacatatttatcttcttctaatacatgaacatcctttttagaatacgtcataggacgatcaccggtacggaggatctaggcaaacaacataagaatcgagcgagtgctaagagcatctctaaaagactaataaaatagctcgtaaagttaaattttagataatcaagagtaaaataactattcaacagactcgctatttggctcatcaatatacttttcaaattgactctctcactatttaaacttggctagccactatgactaactaaactagatagatattttggtggaggaagatgctatatatagagtgtaatatttataaaatgataaatataaagctaaaaataaagagttacttctctaagcacggctggatttcaggcctctagtcctctactagtactagctacacgacgtgcacgcacgcatcacagcatcaacaactagacacgcacacgctgcacgcggccggggaacccactgattcccccttccccgcgcgcggtttgatttcctttcctggtacggatccatatcatagtacatagatccagtagaatagaaggtgatccgaccgccggcgcttgcgttgtttttcccggtccattgaacctgccaaccctcctaaccacaggcacgccaaaccgcgggctccggccaccacccccaccaccaccgccacctgccctgccgcacctctccaaccccaaatccagggggggcaccatgcgtgcatcgatccatcgctggcgcgcgggtccggcggggcggtctgtgagggcaaatttatataggtctagtgggtacccggctacggatagatatgatgctgcactgcacatttgctatatctgaggctcctgcgcgcgccttggcccttggccaggtgtctgtcatgcgggcgatgccgcaggaagaagaagccgcggtggcgacgacgaccatggccgggggcaaggtggcggcgctgctggccacggcggccgcgctgctgctgctgctcccgctggcgctgccgccgctgccgccgccgcccacgcagctgttgttcgtccccgtggtcttgctgctcctcgtggcgtccctcgcgttctgccccgccgcgacctcctcgccgtcgccgatgcatgccgccgaccacgggtcgttcgggaccactggatcaccgcacctatgttgacgctgacgatgagaggtctcgtcgatcgacggtcggcttgcaatggcgcgtcggaatcaagcagttcgcagttcgcacacgcatgcatatgcctgacgacgatgccatggatcggagcgaggaaaaaaaatgtacagtacagggtaaacttgctagtagagtaattggattgcttaggcgcttatagcttagctgcggccttgtagcgtgagtgtgcgtaacagtgctctggttctttctttccattctcatcagctgattgatcagctgacgtacatcatgatttactcatccggttccctcctcctccttcgaattctcatcatccggtgattcatggcgaaaggggctctacctgtgttgttagatagtctaagtagcactcgtcactgggtttgactccccatgagatcaaattttagtttatggttaaaaaaatctcttcgtttgtcccatgccaaaacacgggtctaaggctctgcctcagtcgcggtcgttctcacatggttttttatgtcgctgtgtatgggtggaccagatgcttagggcttgttcggttctaccccaatccatatggattgagggggattgagggggttttaatccatagtaagtcaaaatcccctccaatccgtatcaatcccccaatctatatggattgaaaataaccgaacaagcccttaggggttttctcgacctatgtgagaagatcttcttaatataatactcgagggttgtcttacccccgcaggtcgagttttttttatccagtgattcatgcagcttgtcgtcgattcttttcctcacccataccatcggatcacattgtgttttgggggaatttcctgatttatattccacaagatgtgtgggctgtgtttcgccttaaactcaagcatacggtgcggccttgcacaacctatttaactagggtccgggtccgttgaagcctaatgaatagatggttgtaaatactttttttccctgtgactaaacatttttaacgagacagtcatagaatagctcagttttatattggtcacatatgttttgtacttttatttatgttttatttcatgtgatttacattatgacattttggactactctggcacacttaagtatttgtggggcgtgtcgtggaccgatgcctccgcccgcagattgacacaacacgacctataattagagttgtgctttagtgggtcgtgccttggtgggtcgtactttaatatatctggccgtgtcggaccgaaccgacctagatgtacatgtatcggtgccgtgaggcaaccccttgtctt

SEQ ID NO: 462 - protein, 118 aa, Zea mays
MMLHCTFAISEAPARALALGQVSVMRAMPQEEEAAVATTTMAGGKVAALLATAAALLLLLPLALPPLPPPPTQLLFVPVVLLLLVASLAFCPAATSSPSPMHAADHGSFGTTGSPHLC

SEQ ID NO: 463 - DNA, 5405 bp, Zea mays
ccagtccaaccgcccacctccatgagagttatgtatttagtgtttcgaacacaaaacttatgttgaatacttgtcagagcgtgtaaacttgtgttgatacttctgaacttctgttaatactgtttgtgttgagaacctctcaacttatgttgaatacttatgtcagaatttgtgttaatactgtttgtgttggctatatatgtctgtgatgtatatatgtgatatctatgaaatatcttttgtttgtttggatggaatagggaaaacaaataaaaaaggtgtgtactggtcttgacgagtgtaacactcggcaaagcacctctttgccgagtgtcagaaccataacactcggcaaagaaccaagacctgggcaccggtataggttctttgccaagtgtaatggctctggcactcggcaaagaagcacgctttgccgagtgccacaccaagcactcggcaaagtacctgacatggggaacccctccggcggattctttgccgagtgttgtcaggcagtcactcggcaaagacgccgtcttcgtcacccggcgccgtaacgtctgcttttctttgccgagtgttctctggcactcggcaaatcactttgtcgagtgcccgagaaaattttttcggcaaagaagactttgccgatgcactgtgtgccgagccctctttgccgagtgcgacactcggtaaaacctttgacgagtgtttttaaggctttgccgagtgtttcagacactcggcaaagccgtcggttctgatagtaattgttaattcgcatgcccatagacggctcggtttctgtaccagcaagtacatgcacacttggggggttggggtgcagttgctttgcgcaggctgtcaaggtgcgcagcagggaaggaagaaagaagccatccaatcatttagatctcgctgtgcaagtactagtactacggagcagtagtagtaacaagcttgtggttgtgggatcagccaactgcgcaacgaaaaataattgccactgtatgcccaactcaactcctagctaggagaggaagaagagtacaaggaagagactgtggcaagcacagcacagtggatacacacctagcttggccggtacagagcaccgtgcttgcttgtccatttccgtcacagctagcgcttgcccaggtcccccaccttatcaacaacaactgtgcccctcctgcccccgctcgccgcgagagctcccgtcccgacgaccttccctcctgtagcactctacagtctacaccaagcagcagcgtctcctgttgcatgttgcactgcacctatctacgacgtccgttcccagtgctttgctcaccgacaccgtatcttatgagcaaggagccctgctgctcccatcaccttcatcaagccaagcgtgtgtcctctgtcctctcccagctgcgagctccgacccccggcaccatgtgagcggttccttctcattcaagctcaaccttgtctccgggttcttgcttgcttgcttgcttgctaacaccgctgcctagcaggtccgacagcagcgacttcgccgagctgctatgggagaacggccaggcggtggtgcacgcgcggacgaggaaacacccgccccagcaggccgccttcccgcccttcaccttcacctgcagcagcagagctcaacaaaggcagccggtgccgccgctgctcaagacgggaggaggtctctttgccgacttctcctcggccaccgccggcctagacgccccccgtgacaacgccgacctcgacgacaccgtgccgtggatccactaccccatccccatcgtcgacgaagccagtcccgccgcgcctgccctggcagatagcttcatcccagatttcttctcggagctgcatgcggcggcggcgacgacgagcctcggccctctgccaccaccaccaccaccaccaccagcagtccagcacaccggcgacgacaacgacaaccggagcaccccggttcccaatcccaccaccggcagaggaccagagccctcaaaggaaacccaccgcgcaccagtaccaggtccagccggcaggcctgagccacaaccacaagctgagctcgcgcccgccaggaagcctcggcaggagagcggcggcggggaggctttgatgaacttctccatcttctctaggccggcagccatggcgcgtgccagcctgcggcagaggccgccacagacaggcaccgacaaggcgtccaatgccaccacgagcacccgcgtggagtcgacggtgctacagtcggccagtgccagtgggccgagaactgcagctgcccccgccgtgttcgtggaccagaggacggcgtggccgtcgcagcagcccaaggaggtgcggtttccatgcgcagcagcagcgccaccgccgacgccgacggctggtaacctgcagcaagaaagacctagcaacaacaacatgactcctccgcagaaagaagtagagaccaggaaggcgtcagaggctgcgggcgccaccgccacctcatcggtctgctccggcaatggtgctgggacaggaaaggacgacgagtcctggcgccaacagaagaggaagaccctgcaggccgagtgttccgcgagtcaagatgatgtaagcagaggatgtgaagatatcgcacaccttggacactggagtatctaacactggttctcttctcttcaggatcctgacgatgagtccggtgggatgagaagatcgtgcagcagaggtgcgaagcgcagccgcaccgcggaggtgcacaacctgtccgaaagggtaagtcccatgccaatatgccatgcgatcgatctcgagctggagcctggagctgtgcacttgaactcaccgcactgtaatgcatgcaatgcaatgcaacaacaaacctgcagaggagaagggacaggatcaatgaaaaaatgcgtgccctgcaagagctcatccccaactgcaacaaggtatgaaatgtagatggtagatggaactggtagcaataaacagatgtatcgtctcatcatctctctcattgcgcgcagattgacaaggcctccatgctggacgaagcgatcgagtacctcaaaaccctccagcttcaagtgcaggtacactgactaaaactcgaaatgtagcatggttcttcttccatatagatcgatgcactgacaagatatatggtggttctctttgatgcactgacacatcacacagatgatgtccatgggaagtgggctgtgcattcctcccatgctgctgccaccagccatgcagcacctgcagattcctccggctgctgctcacttccctcatctcggcatgggattgggttacgggatgggtgtcctcgatatgaacagcgcggcggcggcggcggcggcggttccatttccgcacatgcccggtgctcacttcccttgcccgatgatcccaggcgcgccactaccacggggtctcggaatcggaatgcctgccagaaacacgatgccggtgttcggagtccctcctgggcaaccaatccagccaccattcccatctttggcgggccttcctgtcaggccaaacctggcacctcctcacgcctcctcagccgccatggctaacatggtgcaggagcaacagcagcagcagcagcatcagagcctgaataatggagcatcaacagcagcagcaacagcatcagatcctcagactatcgtgcaggtagcgtttcacaaatagtgtatataaaaatagctgaaaagatcttcgcctggatctcttatatccaaatttcacaatggttccaggctgagagacagcattttagtgtgccctcttcagcacaaaccgagagcgatcagtttttggatggtggtggcaacagggctatttgtacaggaagaaatgaggctgaaacatgaaaaacactcagcaggtgagtctctgtgtgtgtgtgacctgactcaatgcaaaacttgacacaaatcattgaatttggcacaaaatattcgtatcctaatagagaacatggctcatgacttttcaggtctcgactaacaggctgcagatgtgaatatcagcgccaactcatcctggaaaagagcctaacgagtttcaagatccacgaagcagatccgtcagttgaaaagagtccaatcaatcaagacagggccatgacaggacgtctagctttagcgagctaagatgctcctaagttttgtgtcaaatgtagatggtagatggaacctggttacaagaaacatttcttggcagccggtgctttttttctttttttttgggattcactgaagttttcttggatcagtatgtcttatttcctcaggcattcagtgatcatatgcacaaagatatttgtgtccatatactggctctgctttaactatatctctttgcaaataataacgagctagctaacaattgttcaaagctgcatgcttaagcagatatgtaaccacattattctgcagatgtatgcatagggccaaaagagcacgtactaatatgaaagttttgccaatttgcagtagagataccatagttaaatatcatttgaacatcaagaagcagaaataaattaattcaaacagatgatctgtatagtcaatatacctttatccgaagttatgttctagattgcttagtttgccacacacacacaaaaaaaaacaataaaatagaagtccatatgctggtcaatcagagtattactttaaaaggtatgtagtcggaatttgaactcaagctactggagagatgtctttaaaaatggagcttccggacagcgtgcaaaaaaagctcaatcataaatatattttacttacgtttgattacatgttagcgtcagcatgttgacttcaatccatcaagtgtcacctttgctaggccatcaggaaacaagcattaaattattagtcatgatatagatcgcgtattatacttaacaatactataataagttcaggacccagcatgcggcaagtacaatgcaagaatgaaaagacgggactaaatttttatctgaaatgctgcacttgagatagtcttaaagtacgtacatcttcttcaacctagaaaaagaaagcatatatgcacatgacggtgtactactagtacaagttcatctgctctggcattttcaatattatattttgcattgcccgcccaattaacactctacagtaaacggtgtaagaggataaggtagttatggtatctaacattattgtaggtataggataggattgctttttccctacctattttattcctgatttgacataactttgaagactggtgtggacaggcatttgatagattcatgcatgtggattgtggagaaagcacaagagaagttccctccaataattcaggtcttttcattcagagctaggagttgtcgtcagttttca

SEQ ID NO: 464 - protein, 254 aa, Zea mays
MQCNATTNLQRRRDRINEKMRALQELIPNCNKIDKASMLDEAIEYLKTLQLQVQMMSMGSGLCIPPMLLPPAMQHLQIPPAAAHFPHLGMGLGYGMGVLDMNSAAAAAAAVPFPHMPGAHFPCPMIPGAPLPRGLGIGMPARNTMPVFGVPPGQPIQPPFPSLAGLPVRPNLAPPHASSAAMANMVQEQQQQQQHQSLNNGASTAAATASDPQTIVQAERQHFSVPSSAQTESDQFLDGGGNRAICTGRNEAET

SEQ ID NO: 465 - DNA, 3971 bp, Zea mays
aaaggttgacggaggtccggggacgaaggtcataacccttgggaccattttaatctctttgtctaaaacaataactagaagccatttctattagtttgacagttaaactaaattacggttgcactattccttctattgatacgacgcaattcccatgattctaagcctggtatgtctggcttttttcgactctgggtattaaaagctgttgcggactatcaaatacctcatcttttcggtccgcttcaaaacctattcgaaatcaacataaacacaaaatcggttgagccgtcacgtcacgatagaagtaatcatctctttcctaaaccttttagaccacttcatgtttctgcacacgtattgttcacgatactcggtcagattctccataaaaaaagttgagctaaacagcccctaaagtatatgtagataagcacgattctagtactaaccgcaggacttcttgagcagagcaaaagatggatactccctccgtttctttttattagtcgctggatagtgcaattttgcactatccagcgactaataaaaagaaacggagggagtattaattacagaagaactgacggggcgcatggtttccacgaggtgggcgcaccccggccacatgcatcggcgaaaacaaaatggcagtcgcgaatcgaaagctgccaagctaggccgcatgctggggatgtgtgacacacatatcattggcggtcatggcaggtcgacacgtgtaggcggacgtcatccatcgtcttcatccctatctatctatctatcactcagtacaagccattgctttcgttatcttccgaggcgggcagggcagggcaggttcttccccccttggcacgcaccgcacgcacggcttgcgtggagccaggccagctcgacgatgactacgcggccccggccccgcggcccagtcctccctcctcttcgatcctataaaagcgaggcccagtccctccatctcaaaaatttcaatgcctctctagatctttcaagctatccttgcttcctagctccctttggcgtgctgtaccggacgacaggggtaggtaggtaggtaggtgtagctagctcggcgagcgagggagcaatccggccaacagcacacgcgtcgatcgccatgccgagaagcggcggcggcggcaatggcggtggcattagtagtagtagtagggtgatgcccaacctcccggccgggttccgcttccaccccacggacgaggagctcatggtgcactacctcatgaggcaggccgcctccatgccgtgccccgtccccatcatcgccgaggtcaacatctaccagtgcaacccctgggatctccctggtacgtgattctttatttctttcttccctctcttattcgttcattgtcacttgagttgagtcgttcagactagttgtgttattcctagctaatccaaatctgcacccagttgaatctcatatgatttaattattctttcttcctcctgtggtatcgtgttcgttcttcagccaaggcattgttcggcgacaaggagtggtttttcttcagcccccgggaccgcaagtaccccaacggcgcccgccccaaccgcgccgccgggtccgggtactggaaggccaccggcaccgacaaggccatcctgtcgtcgtccacgcccacgagccacggcggcgccaacatcgtcgtcggcgtcaagaaggcgctcgtcttctacggcggcaggccgcccaagggcaccaagacggactggatcatgcacgagtaccgcctctcgggcgcggcggacgacgactgcaagggcagcaccaggcgcagagtgtcttcctcctcgtcgtcctccatgagggtgagtgagactttctttttctttttcttcttttttttttaattgcacttgcttgcacggctccagacctgactgaagcgtttcgcatggtttcagctggacgactgggtgctgtgcaggatccacaagaagagcaacgatttccagttgtcgtcgtcgtcggagcatgagcacgagcaggaggagccggcggcgggcggctcagcgacgactgtggaggaactagacgctctcgtcgtcgtcgacaacagcagcagcagcgacaccaccaccaccaccatcaccaccaacgacaacaactctactgaaacagctgcgactcatcacgatcctcagacgatgatgatgctgagcaagtcgtgctcgctcaccgacctcctcgacagcatcgactacgcggcgctctcctcgcagatgctcctcctcgacgcgccccacccccacgctgatgacccgccgccacacatggtctactacccaccggcggcgtcggcgacgcaccagcaagcaataatagctaataacaccaacagtaatgacgactactatgacgacgacaacttgttgccgactgctgctgctactgcggtagacgcggcggcggcggcggtgctactcagctcgtcgcctgcagacaccaacggtgtgaacaagaggaagcgagtgacggccgtggactactacggcgccgctgaaccgccgaccttcttccaccaccacctcgatgatggcggcaacagcttcttcagtacgaccaagaagctcaagccgccgccgccaagtgattcgaggcatggcggccatttcggcaccgccacagcgagcagctaccgcgacagccagcagctcgtggacagcgcgagcagcagcggcgtcttcttccatcagtatgggtacggctacagcagcagcaacccgttcttgaacttgaaccagcagcagcagctgctactcaacagccacatcgggatgcagtagagctcgagagatcgagagagagagagagagagagatgatatatcattggaaggatcagcacgcgtacgtgcagattaattgcagcgagttctatcttgtttgctttcattattatatactccgtatgtgtcgttcatgtaaaattagtttaaattgtaaattagtgtgctgaaattcatgtgcctgctctctgctcatcaatgaatggatgatgacgacccatgcacgttgcttgtgtggatgcgtagatgtgctgcatatggagactgacagagagtgacaagatggctagattaattacattccagcaggtagctggaatcggaatatacctaacctaatactctagtttgcttcctgctgaattctgatgcctttttttcccccacgtagacatggacggttccgtccgtacttaatacagtacgtagacctgagagttcatctattttttaagtgtcccgtgacgattaacttaaggctccaaagtactccgtctatattgaaatagaactcgttctggagacggacaaagcaagtcattttggatgctagtactttatttatatatacggctttgccctctccaaccctttgtttttctgtgcagcacgccggaaaaaacatatgttaatagagagggagttcatcccaagacctcttgtcctcaatgcattgaatcacctgtgacaaccaatcaagacagttttttgtccataatatacagccgcaaagctatttaatatgggcaaacatgacaaatgccatcctaattaaccacatcttagtatacacaatcatgtcctaaacgacttctgttccaacatggagggagtacagtaacatgtaattaagatgccatatatcacaacaacaggtggatcacagattcacactccacatgataaattccactgtagaccccgaattattttcttcttcttagaattggagatgccttaaaaacagacatttgtctctcctgcaaaggacagtccataatgcaaagagacaaaatactccaggacaaacaagctaagtagctacccaactcaactttgatctccccgagaagtccaaccaaatgacgacgggccattaatcgtcggctactactagcttgttcataaattcaacgt

SEQ ID NO: 466 - protein, 475 aa, Zea mays
MPRSGGGGNGGGISSSSRVMPNLPAGFRFHPTDEELMVHYLMRQAASMPCPVPIIAEVNIYQCNPWDLPAKALFGDKEWFFFSPRDRKYPNGARPNRAAGSGYWKATGTDKAILSSSTPTSHGGANIVVGVKKALVFYGGRPPKGTKTDWIMHEYRLSGAADDDCKGSTRRRVSSSSSSSMRLDDWVLCRIHKKSNDFQLSSSSEHEHEQEEPAAGGSATTVEELDALVVVDNSSSSDTTTTTITTNDNNSTETAATHHDPQTMMMLSKSCSLTDLLDSIDYAALSSQMLLLDAPHPHADDPPPHMVYYPPAASATHQQAIIANNTNSNDDYYDDDNLLPTAAATAVDAAAAAVLLSSSPADTNGVNKRKRVTAVDYYGAAEPPTFFHHHLDDGGNSFFSTTKKLKPPPPSDSRHGGHFGTATASSYRDSQQLVDSASSSGVFFHQYGYGYSSSNPFLNLNQQQQLLLNSHIGMQ

SEQ ID NO: 467 - DNA, 9201 bp, Zea mays
tactatggttatatcatagcaattagtaaaccatggtattataaaaaatactataccgttggatgggcatccaaaggactagaaaacgtgattacacgtatagtttgcttgtatattagtcgatgtcattataatactgtggtttgaaaactatgttgcctaacagggcccaaacttgctgttcggaacatgatatttttaatgtgacgtcaaccttaaacatatataagctgtttggtttgaggaatgatctagtccatcgtcttctcactcctcacttttttgtttggtttgtggaatagattgagttgatccatcatcacctcattccttatagttatttagttagtactaatatgaggaattaggtcattccaccaaatttgaggaatggatccatgatgcaccactatattttggatgaagtgattcctcaaaccaaacaccatcatagtgacatagtttgacggctcattaacacggaaatcagcgtttgcattgctcggttcagcttttgggataaggacaacctaggtgtatgccctgttcgcttggttttaatttgtaccagcttctgctgtttttatagtatttttgtccctataaattacagttgtataagtccaaatagtcggatttaattcgaaacgatactaagctttcatggaatgtgctacgaatgggatagttattaggattaattagaaatatgcaacttcaatttaaaaagttagaaattagttcatttcatgctattttatgggcactaagaataaaataactatctaaagcagagtgacatatatacagttaatcctagttattatgatctaatttttatgatggcactctcagcttccgctattgtgatccaagtacgtcgtccatcacgaaacgcacggcacagatattgccacgcactgcccacaaggtgctcggcattgcggcgcacgaactcgaaaccgcagaaaacccacgcctttctagctcctgcagtcctgctgttagtgctgttcccctctctcttccccgtcctgcaggctccaggcgctgctgctctcgtcctccgctagcgagcgaatcgctgacgctggcccgacgccgcggcgggaggtatctcgctttcgatcaggtgcgcgtcctactctaactcccagtcgccttcctcatctggctttcgattcggtccggtctgcgcccaacccgtgcgctgggcgaagcttccggaagcttcagggtttatcccggcatttcgttttcagcgacggcgcgcccggatcgcttgatctgacggagtttctatctaggattttggttggggcgtcgttctccggtgcttatctcatttctatttatcggtgcctcgggttcacggccaaattcgctgctgcgtggggctttggagattggagccgattccttaaagtggcggtggcagcgtctggtgggaaccatgagcttcgtgttccgaggaagcagggccgacatcgaggccggtggcttcacagggttcgcccccgagcgccgcaccatggtgagtgtctgtctgctcaacccatgatgcatttctgctaaaatgtaactggtggtagtgtagcttaaaccggtttccttgtcctgatgtctgatcccatttgtatgtgtgcttgagtgtagcgaattcatgcagggagcaggccggtgaatagcaattccttggtttttcttctaactggtaattgggtcgcctatctattaccgacactgttgagctgctaaagattattctttggttaacgttgtgttttttgttgggcagtttttgttttgttcatggtactgaactcacaccagatgtctcccaatcttttggtaggttttcatgctctgtgcaagctgtccatgatttggttaaaattgttttcttattcgtataaagcatgcaactgtggaacagtttaataaccacatttttgttggattgtgcgatcttttcttttcttttagctttggatagtcttgggagccttcctaatggccacgagccttagaatgtatgccacgtgccagcagcttgctcatgctgcagctgccaacagttttcttggccacactgagctgcgtgtgcatgtaccgccgaccattgcccttgctacgagaggccagttacagagccttagacttcaactggctcttcttgaccgtgaatttgatgatttaggtgtgccaatacattccatttgactcatttgatggtttacagtgtttcctgaaaacttagtgacgtggaattctttttgtttcagattatgacactctgagagcactggatgctgacaatagcctgcatgttccttctatgagtgaagaagaaataaattctcttcctgtcttcaaatataaagtccaggcacagcagggaaatgcccctgcccgaaaaaggtaagacgaattatcctttgggtcgatttgttcatatggccataccaagtttgttccagtatctcccatcatcaacaaatgaccaaacatttaattctgaattggagacatggattaatttgtctctatgatgtgtttctaacgaatgtttttcaacagtgatgaggcatcgcagctatcggtttcttcaactggctccggcaatgaggtaactgataaaattgacttgtttctcatggtgtggtagcctgaaaagtatcttatccaatcatgtaggctgttaaaaagtcatgttatttgtgatgtcacagttgttagtcgattgtatatgcaatgatgttcttataatattccattgtaaagacaacatatatgtataactgggcaatgcacttttggctcaccctcatttattgaattattggttgttgtctggttagctttgggatttattaaatattttgtgtcaagactcaaagagttttctagtatttgatgtaaaagctagtgtttagaatcacatagctgctgtgatcactgatcaccatcagcttctgtgcagtagcacatgcatggttcagactttgggccacgatgattattgtttaactcgattctgccttacagaaaaagcaggatggtttaaaagcagatggaactggcaaaactccacaggatgaactaacatgtagtgtttgcttagagcaagtcatggtgggtgatctgttgagaagcctaccatgcttgcatcaggtaatcatgctcattatcttccccttggtttttctagtatggaaacagcagatggtctcgattttgtatttttgtttcctttctgaaatgatcctgataacaccttttattagctctaggttgatatggtacttgacatgttagctaacatcctaaaacaacgccacgaaaccagaatcatgtttgatgtaccaaaagggttaactggtgcattttacacattttgtggatgaatgctttgatattgtgacatacttatgataaaagtttttaactgttattgtttgtgtgtgatatcttactttacggtttacatcttgcacttagtgtgactaggacacattctccaaatgcaactttgaatggtacttcttgctacaaaatatttatagaacatagaaaaaaatagtttatgaaacttccaagacaaacctacctggatatttttcaaatacccacacttagaatataacaagtaatgtttaaccagataccagaatttaaaatcattgaattaagacgactgcaaaacaacacttgtttctggctggactactggacggagtatgcaccagtgtgagatgtcatgttgttggttctggagaacagaaagtagggagtgtcattgtagtttactagtttattgtttttacactcagatctggaattctgtggtttttttgaagcaatcttaaatttgactggttacttggtacatcgataactttctttgctttgtcattctttgccccgcagagttataatttgtcatatttttacacacgcctgatcataatatcaggaatcacatgtttataaacaacaatatagatcaggaagacaggaatcacaagtgaattaggattaagtggcattagaggtgtgatcttgacttacccaatccatctcgcggtcttgccatgccattggcttcctatatttgaaggttggcaagaacctaagactatctccgataggtcctgtaaactgttccctactctatatttagagaagattcttctcctttatacattccagcggtttccactaaagcgtcctctaaatatagaggatgctcctttgtcctttatatataaagactcatcttctctatccatttttatactttaaacaatagattaaggaaaactaaaatatgtataagacatttgatgatatgacaaatacgtacgtacaaaaatctagagcaaaatatgtatctaatatgggtatttaacgtatagaggacgagatatagaggacgctactggagaggaatgagatatagaggagaaaatcttttagggaccgtttggatcccttcattttgaaggaattagaatttacttaatagagtaggttatttgttttgaaatttaacattgcaccacttttcaaagtttagatataagcttatcccaaattcatagttagaggggtggaaattaattttatgtatcactagtctgtgtttatactctgcaatttataatacgatcaacggttggacacaaagcagggagaaaaggatatctataggatggacaagattcgtgaaagggagacaagggatgtcaaccaagtcaaatgcatcaaggatgaagcaaaccaactattagtgaagaatgaagagatcaagaacatatggaaggagtacttcaacaaattgttcaatggagggaatgagagttctacaatagaattgggcaaaccattcgatgacaacaacaggggttttgtacgaaggatacaagaatacgaagttaaggaggcgctaaaaaggatgaaggtaggaaaggcgatgggccctgatggtatccctatcgaggtatggagatgccttggagacatagcgatagtatggctgactaagcttttcaacaccatctttcggacaaacagaatgcccgacgagtggcggcggagtacgttagtaccaatcttcaagaacaaaggagatgttcaaagttgtactaattaccgtggaattaagctcatgagccatacaatgaagctatgggagagagtcattgaacaccacctgcggaatatgacgggcgtgacccaaaatcagtttggtttcatgcctgggagatcaactatggaggccattttcttactaagacaacttatggagagattcagagaacaaaagaaagacctgcatatggtcttcatagacttggagaaggcttatgacaaagtacctaggagtgtaatgtggtgggccttggaaaaacacaaagtatcaacaaagtacattaatcttattaaagatatgtacactagtgttgtgacaagtgtccgaacaagtgatggagacaccgatgactttccaattaacataggactacatcaaggatcggctttgagcccttatcttttcgctttgatgatagatgaggtcacaagggacatacaaggagatataccgtggtgtatgctttttgccgatgatgtgatacttattgaggagagtaggagtggtgtttcgtaaaagttggaattgtggaggcagacgctggaagcaaaaggttttaggcttagtaggtctaaaacagagtatatgaagtgtgatttcagtgccatggggtatgaggatggcgatgttagtcttgatgggcaagtggtacccaagaaagacacttttcgttacttagtatcaatgcttcagaaggagggagacatcgatgaggatgtcagtcatagaattaaagctggatggttgaagtggcggcaagctgcgggtgtcttatacgacccctgggtgccacacaaactaaaaggcaaattctacaggacaacaatccggccggctatgttgtatggagcagaatgttggcccactaaaagacgacatgtccaacaactaagtgtggcagagatgcgcatgttgcgcgggatatgtggtcacacaaggagagatcgagtccggaatgatgatatacgagagagagtaggagtggcgtcaattgaggagaagcttatgcaacatcgtttgagatggtttggacatatccaacgaagacctgaagaggcaccagtgcatatcggaataattaggcgtcccgagaatgtgaagagaggtagaggtcgaccaaccttgatgtggacagaggctgtgaagagggacctgaaggagtggaatattgataaagagctcgccgtgcatagaaaggggtggaagtgtgcaattcacgtgccagaaccatgatttgtagtttcgcttttcctccttaatcgtttgaccttctcttgtgcccttttagatcttgctggttcttatgggttttatctctttttatgtgtttccccgtttcatcgtttttcggttctcctttgcctttgtctcccttttctcttctttgggggttgagctctgaggttttcatatggggtttcatctctagcctaccccaacgtgcttgggacaaaaaggctttgttgttgttgttgttgactcgctcccctatagtagaaatgtagcatataaatatctctcccatatggccaacggtagtatacaaatatattctatttagaatcatattagcttaattgatatatgtctaattacgattattagaatgtaattcatttccaagaacccaaacggaaccttagagaaaactgtaaatgagggacatagaagagggatatagaggatatggttgaagatagtctaagagactattgtacaaggcttgctatagccttgaggccttggccataagcacaacctagcttttggcctgcgtatgcaatgcagacgcatgtcagcttgtgttgtcgaatggagaatgatgttgttacacgtgcataattgaaaatgtatcactttgaagatatgcccaacatagtgctaatgtgattagtgacagaaaacaaatgcaagttcttcacatggaccccaatccaagatagaatcgtagcagtagataatctaccaaagagggatggccacaccaaatttcctgtatgtgtcttatgccccttcacggttgacgtctggaggagggtgctagtgtgggggcacttctctttaactccgcatgcacaggttgcaaagtgcactaaccttaaagatttgtgggaagctgcagtaaagatagtagcaaaaaaataaaagaccacttcaacgggttatgcatctatgtcatgtgggatttttggaaaaaagaaatcggcggatttcccaaaatgattgctccacgcctataatgattgtgctacgcactaaacaggactttgaacaacgacaacatgcttttcaaaaactagtgttggaggccttcatgtgcaatttgtttctgattctttgtggtttgtctatctcaagggcttgggttcctgttgaggcgtgtctgccccttagaacacccttaacaatagagtcaacttgttagctcatataaacttaaaaaagataaaaatagagtaacacgatgacatactagtatacaaaatcgagacacatgtatatagtaaagtgtttgagcttagttctttaacttgtcattacctcttcttattcaataaaatgttttatcactttatgacctagctcttcaaacactgtttggagctacccttggcaaaactccgtgtcctgtgttctcccttcaatgcaaggcagagctcttcaaaaaagaagtgttaatgtgatgtgtcctgatgaggcaacaatcgcaacactgcaagatttcttactttgtcttttgttttgcagtttcacgtaaactgcatcgacccatggctgcgccaacagggtacatgcccaatctgcaagcaccaggtcagtgatgggtggcatgccacaggcaacggtgaagaggatgcttcatacatggtgtaagtagctgcccaggagtaggccataggtaactagtagctgctaacagaatccgtggaacgctgttttggaggtgacggtttggacttgcaatctagggatgtggtctaatccctgtctaccctaacaaaaaaccgagtgtggaatcagctgtccagtgcactgagttcttgtacaactcatgtttatttctctcattctctgtgatgttgatgcataaaaaggttgctgataatcttcttacccgtcctttcttagtatgctcggtttcttttcttttttgaacgcaatggcagtagctttatgctttgttaaaagaattaaagaaacaaaattggcctagtttacgagggaaatgagcctagaatagggagatatccgatggtcgcacaaggtaaatacttcattacccgtaatcagtacccattatggatataaaattatcccatgctcatgtccatcaaaatttcagtagacatggttattttaatcataaaataggtatcaaatacaaactattaaagcctcatacatcatcaacaataaatataataaaatagaatattatgtttgtgtccgacatgacaaattcttgaaactcgatatagttttatcacatgtttaacatttaattttatctgaaacacttggtaatctcaattcccttgtcataggttaacatgtttttcatcggacaacagatcatgacagagaacatatacatgtctaccatagccgaccgatatatagtaaatgatctaataaaatatttgtgagcatcaaaattcatcatacatgtgctctaatgggttttttaccttcggatacccaatgacatctctattcttcaccaaattgtcggctcaagttgttagatttggtctaataatggacggtggcaactgttagaggctgctgctggcgcgtttggaggaggaatgtgttatggcggcaactactgcatctaacacagtgtcgctggtcgcgataatccttctcctgtttttatttttaaattttatttcggaaacgggttcgaaatcgggactagcaagatgacgaaaatgaaccaaaataaaaagaacaaatcataacagatcagaatcagacgtaaaagcggaaacatcgtcatataaagtataacaataaagtagtattgtgatcaattaaaacat

SEQ ID NO: 468 - protein, 280 aa, Zea mays
MSFVFRGSRADIEAGGFTGFAPERRTMRIHAGSRPVNSNSLVFLLTVFVLFMVLNSHQMSPNLLLWIVLGVFLMATSLRMYATCQQLAHAAAANSFLGHTELRVHVPPTIALATRGQLQSLRLQLALLDREFDDLDYDTLKALDADNSLHVPSMSEEEINSLPVFKYKVQAQQGNAPARKSDEASQLSVSSTGSSNEKKQDGLKADGTGKTTQDELTCSVCLEQVMVGDLLRSLPCLHQFHVNCIDPWLRQQGTCPICKHQVSDGWHATGNGEEDASYMV

SEQ ID NO: 469 - DNA, 4810 bp, Zea mays
gggccaccttggacacaaggagagccaaaaccaagggggttacatccaattaataactaattatcttattcaaatcgcacccatatggattactcaacaaaaagacgtggtttttaagagaatttgagtttccaaactagccctaattcatggtaattgatatcatcatcgataccagcgaagatgcaaaataaggagaatcaagggttcgaggtgacgaagaatatggtactgcgagaaaaaaaactacaataagatccatgaaaatgggttgttaatttgcaaatggttttttgagcgtgaaagatgtgatatcttgttttcttttggtatgctcctcttatttcttcataaacctttcataactactataatatatcgtttcaatatgtgttactttttttatatctaccatttttatacctgcgagaaaaaaatattagatcgagaatcaaacatgtatctatgtctatgtctataaaaacgaacttacatctaaacctacactcagagtttttatccatagaaatgtggccgttgctaatcgtgagtattaccatacttgtaggccgttcggcctaacacagcctaaaaacatttaaattttagagcagtacgacatgtaataaatatagaccgtcagcccacatactcatctctcggcccacgacacggccgggtcgccggggtcgggtgcgtccaccgtccagtcgcggcggcccgccacgtcaaccgctccccgatcattctcatccactcctctgctttcctcaaactcaaaggaaagcacgcgagcagcttcccttgcacgcctccctctcctctcgtccatccgttccccccttcccctgcttcccggctctccctccccccatccctgcacgccccttttcatgcgcgaggaggggccgtggggaccaccaccagcacctccatccgcgcgcatctcgcggtggtgctcctcctcctcctccccctgctcccggggcgggcgctctcctgttcctcctcctcctgctgctggtgccagggccgggagggcggcgcggaggtggcgctcatggggctcgccggggacgggtcggcggacaccgccaacctcaggtattatcccctccctctccctgtctttctgttttcgctttggcccccatctgtccatccatcaatccggttgccttcgctaccccttttaggaggctatgacgcctcggagccgagatccatggcatcggggatggataatggattacgctgtaccacccccttccccctgcttgtctgaggccgtggattagtgatgccgcaattgggcaccgggcttgagcgcgaccagcccattctttcgtcttgatctgcgcgattgatatagtaacctgacttgtggccacttgtttgatcacgtcgatggtgagggcgggtcgctgcctgccctgggattggggtcagatcgttcggtacctatctcctgcctctcctcatgattgtcgctgccagccacttctcaggttccggtgccggaaacgtcaggatctgctaagattggggacatacatgactgatctaagctccagtaactaaacctcgtgccttttgttttaaccgaggattctctaggatttcgtgtgctcattagccatattggcctcgctgatctattggggcacttaagtataccccttgcaaacattgcatccatgctctttcatactaaatacagacctgactagctagatgtctctgtctgcaagtctgtctatatttggtgcttggtggcaaacggctgacgagcttatgttggttctttaatctttataatgtaataacttagcatactagtgtgttagatagactgcattccattccaaactaattaaaacagaaagaaaaagttactgttactctgatgaacttgatgggagttagatcctggatttttctggaacatgaagcacccaagcttcctgtcagctcaatcagtttatctatgccataggaaattcctcatactgattttctgccctgtatataacagtgcgtgcaatgtcgtgtgagtccgaatacacacctatttgacacacaacgtttccacctgcagtaatagtgaaaatggtcggttcagttatggagttgcaagttctcccgggaaaagagcatcgatggaggacttctatgaggcaaggatagacgacgttgacggagagaaagttggaatgtttggtgtgtatgatggtatgtattgcctagtgacatctgaaatcatatcaattcagttggttcttctaatgccagcgctccacgatggcattgatattttcacttataaggtgagcatgttttttctgtttctgtaggtcacggaggagtcagagcagctgagtacgttaagcagcatcttttcagcaatttaatcaaacacccaaagttcatcactgataccaaggccgctattggtatgctcatactaactattgaggacttttgacttctacactgacatatgatggtcttgatatcctcccgtttttttttttttttgctgcagctgaaacttacaaccgcacagattcagaatttctgaaagctgatagcactcaaactcgagatgctggctcaactgcctcaacagctattattgtaggtgatcgtttgcttgttgcaaatgttggagattctagagctgttatttctaaaggaggacagggtaagtttaccgtcgtaacatggcatatctcagtgtctattcctatacttacacatgtatcagaaacttctgtttgctgtgtattttcctggacgagtatttccccataacgaatggatgaactgtgtgcatttggtagagatccagattctctcagaaacattttgggttcagtttcttcttagaaacgtttctggtgctgaatcagaatcagtttctcaaatcgtttgtcaggattccaatctaatcgcattacacttcaacaattttatgatgttttccccatcttgacctgcagcaattgcggtttcaagggatcacaaacctgatcagacagatgagaggcaaagaattgaggatgcagggggctttgttatgtgggctggtaatggttcctctgaatttttcaataaaaagaaaccatctatctcagtacgtgccgttactgttatttgtactgtttgattattcgaaatctgtagggacatggagagtgggtggcgttctcgctgtctctcgagcatttggtgataaactcttgaagccgtatgttgttgctgaccctgaaatcaaggtttgtcatgcatttttgtttttactatggattgcctggatattttttccaaacatatcatggtttgaggaaatatggtgcgtttgtaataaatgcctaaaaacggggatcccatcataagcaatgtcatacatcactcccaacccccctgtagccatctgaaaacggcttttgctattacaatcaggaggaggtggtcgacagctcccttgaattcctcatccttgctagcgacggactctgggatgttgtcactaatgaggtacctacagatgttactaaatatctccttcggtgcaattggtctgtctgtctgtcactccacctgatgtaatgtattttacaggaagctgttgccatggtcaagcctatccaggacccccaggaagcagcaaacaagcttctcgaagaagcttcccgaaggggaagctccgataacatcacagttatcatcgtccgcttcatagacggaactaccggtgagaaatcaggcgacgacaaagagaccaccaacgaccaacactcctagctgtctcgtgtagggatccatcgtgctgtgtgttcttctggctgttgtacctgatgctcagagtagacgctggctgctgctccgcaaggaaactgactcccccgaccgccgttcatgctcctggctggctggctcgctggccgcctcgacgggaacgctgccgtagaatgacgactggggctggtgttgttgttacagtatggtccttttttctttcttctttcccctttcatccattaagctctgtgatgtagctgcccgtgctgttgattcatgaaatcatgctagagattttttcctggcagtaagtgcgtgcctgtaaaactgtcgaacaatttggacgaaaattgtacactgcagtatgtaaccatcaaaatctccccccctacattcgccttgtggtgttctgctgtcatgcctcctgaaaattgctaccaagccgtggatggaggtgtgcaaggaatcggaaagctcgagattctacagagcaagtgcgtggattatcatagtactatcaagcgcattgattggtacatatatgaatttcgaccaaacaagaacgaatatatgaatttcgatctaaaccgtaatcaggaacatgcaagtgcatggaactaaaaagaattcgtggtgctgactgctgacaagtcccacgactcttgtcttgtgtccctgtcaacccacccacattcacgcacctgtaaaatagttggtatagaattgtttatttaaagctagagaagtctggctttgtatatattttggaacagatgggttagagtaggggtgagttggtggtgccttggccttgccttgggttatccggctttgattcggtcagtcgtagtagcgtgagtgaggtagctggctagtctcgaccctacttgaaaatggagatgcggaaaaaaaaaagctagctagaggccatgacatgggtctcggcaatcttattatgccttgactctaagtgcatgacgaggcacgtgcatccgattcaggggtc

SEQ ID NO: 470 - protein, 290 aa, Zea mays
MGLAGDGSADTANLSNSENGRFSYGVASSPGKRASMEDFYEARIDDVDGEKVGMFGVYDGHGGVRAAEYVKQHLFSNLIKHPKFITDTKAAIAETYNRTDSEFLKADSTQTRDAGSTASTAIIVGDRLLVANVGDSRAVISKGGQGIAVSRDHKPDQTDERQRIEDAGGFVMWAGTWRVGGVLAVSRAFGDKLLKPYVVADPEIKEEVVDSSLEFLILASDGLWDVVTNEEAVAMVKPIQDPQEAANKLLEEASRRGSSDNITVIIVRFIDGTTGEKSGDDKETTNDQHS

SEQ ID NO: 471 - DNA, 3838 bp, Zea mays
accagaacagcacagcacaggtaatagtttctgcaggtattcgtttgcagccgctacaagcgaaagctgcagctgcatgcttgacttggactccacgctagtacagagtcactggacacacactgacacacacatatggactctggagtctggagatagagcatgctgccacgctctatttccgcggtacactgtacccggacaagtacgtcatgcacgaacaaatactggtaccgtacgtagcgcgtccttcgagtttgaataggagtagacgatcacgggctacgtccgcgcatatagacggaggtgtctccgcggcagccgagctagatgtcaacagcgtcctcgtcagatctcgcgcgtcgcgcacggccggggttggctgtatctgtctgtatccccacagaagccgtaggaaaccggttcagatggtcacgcctcctcgcggctctatcagcagtgacctgtcccgtttgggaaacggccggagagcaacgtcacccgcgcagtcggattctctgccggacaaccgaacagaaaaagagagcccgagttttcgtataacaccgccagtatctgtatctatccatctagctgatctgatctcgtgccgcaaaagataagtcgacaacaagcacgtgcggtgtgcggaatgtcgtcagggtcttggagtgcgtagagtatttttgttagccatagcatgcgacgacgcgtaggagagcacacaagatcctcctgctgttcgtaattccctgagtaaagatccaaacgaggaagagacgtccactcgctagagccgatcagtcatcaaaccagctgagcgaaccgcaccagctgcgacaagcaccacccggcacccgcacggccgcacctgggttttctcgacccatctaacccgaaccgtttctaatcactacgtccacgcctgcctggctttcgcatgcaggctttaaggaccgcgtgccgcgttcgacgacgcatcagcagagcgctaaaaggagtctttgcagttgcaggtcgagtgagatatgatatggcgtcggagaccaccaagaacgtgaaggccaccctcgacgagcaggaggtaacctcgcatcagcgcgaccagagcgctgccgaggaggaggaggtggtggtagtggtggatccgctggcgcggcagtcgtccgtcatgtcgcttacgctggaggagctgcagagctcgctctgcgagccggggcgcaacttcgggtccatgaacatggacgagttcatggccaacatatggaacgccgaggagttccaggccgccaccgccaccggcggctgcagcaagcaggagggcacgcagcgggagccgatgatgcccgtggcgaatggaacaggtgagaacggaggattggttcggcaggccaacgcggcggcgcaggccgtggtgcagccccagacggggagcggcggtggcggcggcggcgtcgccgccagcgggcggcagcaggtgacgctggccgacatgacgctggaggacttcctggtgaaggccggcgtcgtgcggggagccttcgccggccacggccacgcggtcgtcggcatggccccaatcccagccgggcggatgggcatccagcagcagcacgcggctcccacgatgtcgtaccaagtggcagcgccggcgcccaacgccgtgtacccggttatgggcaacggcacggggtaccacaacgggtaccccagggccatcgcggtggtgccgccgtctcagtgcgtgacggccgccgtgagcccggggtcgtcggacggggtgagcgcgatgacgcaggcggagatgatgagctgcattggcaacgaaggggcagggacggtccggaactacggcggcggcggcggcggcggcagcgcgcggaagcgcgactcccccgaggacgcgtgcaccgagaagaccgtggagcgccggcagcggcggatgatcaagaaccgtgagtccgcggcccggtcacgcgccaggaagcaggtgtgcgtgctgttgttcgcgtcagtttcgtggtcggtctttgtttgggtcattggcagactgccagactccatcatgtgctctgaaatggcgctggtgtgcaggcgtatacggtggagctcgaagctgaactgaaccacctcaaagaggagaacgatcgcctcagagcagagcaggtagtgacaagaatggccatcatgtccttttcctatccgctatgcatggctctgatcggacacgtctcttctttttctttttcttttttttttcagaagacgattctgctatcgaagaaaaagaaggtaacttcccctcaatagcgctattctttagttttacggagtgtcgagcatttgctagctgtcggtgtaacaatcgacacgctcgatcatttgctagttgccagagcaacaatcgacatgctttgtcaagacaagtgacctcaaaccctcatgccatggctcattggctttcgtgtctgttttcagctggtggagaagatggtggagcaggcaagggagaatgtgagcgccaagaagggcggtcgcgggctgcgccgctcgggcagcgccatgtggtgaactgtgacgactgacgagtgtctcgaattgtgcagttccagtccgcttgcttagttgcttgtatgggaaaaaaatcctgtacctgtcggtagcagcaccgttagtaacagtatgccatgtggtcgacacaaacgtctgcgagggacgatatggggcatgggcgagagcttccgcgttggcctgctgctgttcatgagcctgggttgtacaaacaataaagcaactgtaagatagtagtaattaaacacaaagctctgtgttttcgtccatgtttgtttgacaggggccatactatgccgtatgcatgtcagtgtatcttttgcatttgactctgatagatagtctcgtgtgcggtcgaatggtcgtctagcttggattcggttgtttcagaggctaccaacaacagccgaatgttcagaagcaagaaccgacaaaaatctgagtgctagaggcggtgaagagttggtgtagtcgtcctaccaactcttcaacgcaagcctcgctgctccgtgcccgcctcctcgcaccgctgctgctatcacccgtcacgtccagttgctcatcccagcatagtacttctttgagtaagccatgccgatgaatagttggtgtagtcgtcctaccaagcataccagaatatgtcatcatacgggaaaccagcggacggtcgtccgagcgatcgacacacgtagagctgagatacgtagctgatgcaatcatctctcttgaatgtggctccgaccacatctgagtgctagaggcggtcaagtttcaagcatgtcatcttgcttgacctgtcaaccagagaaggatatgcagtgatcggtgaattgctctgcagatgcacaataataaataaagcatcaacttctcttggtcatgtggattggcaatgttggttgcactaatcggctcttttgatatgattgtcctcttttcgtgagttgattttttttacgaaggggtgaagccccctatttcattaagaaataggaaagtttgaaacaaccgtcaccccgcggcacatcatcccaaaagatcgaacacggccaggaccctatctagactctaacctatcaagctagatcagtgaagagcctaagatagcagaataagttttggcctacgatgaactacataagactttcttatttacaacccaacctgacaggcagaagccataaaaggaactgaacattctagccaacaaaagacagacaaatatcaacatcatcttccaagttccagcttccaaatcaaccagaaa

SEQ ID NO: 472 - protein, 385 aa, Zea mays
MASETTKNVKATLDEQEVTSHQRDQSAAEEEEVVVVVDPLARQSSVMSLTLEELQSSLCEPGRNFGSMNMDEFMANIWNAEEFQAATATATGGCSKQEGTQREPMMPVANGTGENGGLVRQANAAAQAVVQPQMGSGGGGGGVAASGRQQVTLADMTLEDFLVKAGVVRGAFAGHGHAVVGMAPIPAGRMGIQQQHAAPTMSYQVAAPAPNAVYPVMGNGTGYHNGYPRAIAVVPPSQCVTAAVSPGSSDGVSAMTQAEMMSCIGNEGAGTVRNYGGGGGGGSARKRDSPEDACTEKTVERRQRRMIKNRESAARSRARKQAYTVELEAELNHLKEENDRLRAEQKTILLSKKKKLVEKMVEQARENVSAKKGGRGLRRSGSAMW

SEQ ID NO: 473 - DNA, 3340 bp, Zea mays
tatgtaactatgtcgttgacctttataaatttgtattacagggaaatattatcttgttgacttcgggtaccctaacaggaagggatacctagcaccttataaaggtcaaaagtaccacatttccgaatggcagcatgggaggcaaccagttgttgcgaaagaggtatagtattcaactatgcgcactcgtcgctgaggattgttatagagcgattgtttggggtgctgaagatgaagtggagaatcctgcttagactgccttcattttcattgaggaagcaattgaagataattatagcatgcatggcgttgcataacttcattcgggacagcgcgatacacgatcatgactttgaccagtacgtacctagcagtaggcatgttgatgatgtagttgtaggtgagagtagtagcaccccgcatatgagttagatatgagtgcttttagggattctattgctaatgtgttagtgtcgtaggtacctatctgggtgtaaataaataacttgtacaagacaaatcatgaggtattgtaagtaccttatgattgttaagcatgtttgtgttttttccattttttctctcagaatctacactaaaattctgaccacccgttttttttcacagcagtcgaactaaacaatcagatttttatcatccagcttctccttacagccagattttccttatagccagcttttcagctgaaccaaacaggctcatagagtggttcatagagtggtgaggaaagtaaatgcatgcaaattaacctatggaacaaaaggggtaagaactaagaaatagcgcagtgtgtacattgttgcagatcagtggctgtggctctagccggggtcctccctcgcgctcgtcggccctccgctaccagggcctcgcatttcacgtgctcccctttgcctcgctcgcccacacgcacaaacaaacgcgaaggctgcccggccctcgcggctatattagccagcgcctgcccacgcaagagactgcacagagagaggcctaagcaccagcaccagcaccaccaccagtgatccggccaaggtccgtaccgaccaaagacggccggggaggagatggccgcctccgggaccgggaacaacaggttcgcccatacatgcgctcgcgtgcggcagttcatgatggagcagaacaggcaggtgcgaatggatgacctcatcggctcctcctcgtccccgaggccactgcaactgacgccagtccctgtagcgacggggccgccgccggcggctgcctgggagaccgacgccggcgctaggactttgccgctgttccccgtccgcaatagcagtagcacggagatcatcaggtgagcgagctcgagttatgcattaattgatctgctggctagctgacgtgttcttggcccggcttaattaatttctcgatcggtttgttgcaggccagagcaggaggccaaggccaccctaaccatcttctaccagggccaggtggcaacgttccacaacttcccggcagacagagccaaggaccttatacaaatggcaggttctgtgaccggggaggcgccggggaaaggggtgacgacgacgaccgccgtgccagaaaaggccgggaccagtggtggtgagccgtcggctgcaggggtagctggcacgccgcccatcgcaaggaagctcacgctacagaggttccttaggaagaggaaggacaggtgaggacgagagatcacatgcgtgcactctctcacatcggatttgtcttatcagtaacttctttctcgatcggtgctgtttggaattttgcatagagcattggatgatgacaatgcgcgtgtgtttttactcgcaggatcgccggcgctgacggccgcggccacaatgaggatgctccgccgcggaagaagacagactccgctggcgccggcgccaacgaccccgccgaatacgttcctgatgaagcctcgtggctcaggctctgaaacccgctcttcactgcaaatttgcaggagaataatatgaatgagaagggcaagagtgctggcatgcatgccacacatcctctaaaatgatacaataatagtgccgtgtgtgcctgtcagaattcctaagaattcttaggcattgtttgaaagggctgtaacttttttttctgaaagcaccttgccgtgaagcttttagaacatctctaacaggagagatgtatagaactctagcgcaaaaaattgcttcaacgagagttctattttacaaaaattcatcaaaattataggactctgtcagatattgttaacattttatttcctaaataatatgatataggactcagttttgttggagccgtaaatatttttatggccttgaacactttaaatcaggtcttattttaaattttagaacttaaatatatgactttttgttgaatatactcttaaaaaacttgaaaagatgctctaagatagtttgtgtgcttttagtataaagtgcagttttttagagtttttgtaagttagaagaagcaaccctcttatttatcaagcttatggcttttcgaactttttgagaaaagcaaaagctggcggaagcttctccaaacaaggatcttaaaatggttatatttcctttgatttaaggctggctggtaaacgattggcaggatcgtatcctttgcatatctgttaatgcttttctgtggtaataatgaacaagcaggatcggtaaactgatggcaggatcgtatccattatccaatgtgtgatctattgctaactttcgtttttccgatcaaaatagagagattaaaacaatgttatcattatattattaacaggtgcttcatataaaaaccaagcaactaatactcggtttgaatctcatggtctatagtttagttagttaaagttaatgactaatctttaaactattttggatcgccgtatggtctaataacctaatcataatattaatctggataattttcatcaacgagaggctgacaaaaaataggctgaacagataggttaattatttacatccatcaacaacctagggtgattggtccatcgggctgtccacatcacgtcgtgtaatgagaatttatactgtaaattacactatttatagaatgaagtttgaaatagattatgagataggataactgttgggtcccgtggctccgtcgggcacgccttccacccactcgagccacccatttgcaccatttcagtcattctataaaaccgatgtcagccatttcgtgtattgttcagccattccatggaactaatgtcagtcattcttgttttgttcggctattccatggttctaatgtcaacgacctattttta

SEQ ID NO: 474 - protein, 218 aa, Zea mays
MAASGTGNNRFAHTCARVRQFMMEQNRQVRMDDLIGSSSSPRPLQLTPVPVATGPPPAAAWETDAGARTLPLFPVRNSSSTEIIRPEQEAKATLTIFYQGQVATFHNFPADRAKDLIQMAGSVTGEAPGKGVTTTTAVPEKAGTSGGEPSAAGVAGTPPIARKLTLQRFLRKRKDRIAGADGRGHNEDAPPRKKTDSAGAGANDPAEYVPDEASWLRL

SEQ ID NO: 475 - DNA, 3955 bp, Zea mays
aaaacctgcgggattaacttgagaaccgacttgtaatgggtccagacctccaccctttttatagatgaaggggtacaaccgattaaacccccacaatcgatcaaatcaattatatatacttatcatttttaccttacgcattaggagtagccctagtttagccttcatctatctcgaaccttcacatctcttcggctctatgttaactagaggcgtcttgggtggtctgccagcctcaagacacaccctaagatctctcctacctgacgaggtccctctcgggatgcgagatctaggtctactacgaagaagacagccctctacgccatctggaccgtccgagccccaagcgtagaccttccagacgtacgtagagaaggagccgctcttgcgttcaagttgtggactgtctggcccagggccgcggatcatctgcgcctccgcagagagcaccgctagacggttcatttcccggtgtttaacgtccagatcggcaccaacagtaggcaagagaaaagaatttctcaagagaaaccaagtagcatgaaactttgtctgtgtgtgttaggattatgtcaaattcaatgcaaaatgcatttagcggccacaaatcatattagaaccccaaagcacaaactgacaaaagcaatgcataaagctacatgggaagggatttttggatccagaaccctggaggaacatatcttgaagttcatgcagatcaaagtaaaagttgggcgtatttttcaggctgttttgtttacctggggaggctcaaactggtatatgaagcactgctgcttagtttaaggattgttttgactgccgtacctgggtggtgtaagtgtgaaccgaaagggacggagacagtcttatctctcctagattgtccttattgagtcactgatccgccatttaaataaaccatgacagcttcaaatagagaaggaagtacatacaattgtttaatcttcaggctggtgggcctcatcaagcacctctggccttcatatataaacacaaggtgtgtaatagatttgcaagtgcagtagtatacagttcttgggtgttgtcttcacctcagcagcttcatcccagaaagccattcacaagataccttgtaagtttgtaaccaggagcaagcaggggcttcatcgctttagtttgcaaggtatggaggagaggaatggcaccaacatggagaagtcagatgagatcctgatgccgggtttccggtttcatcccaccgacgaagagctggtcagtttctacctcaagaggaaggtccagcaaaagcctatctccatcgagctgatcaggcagctggacatatacaagtacgacccgtgggatctcccaagtaagaagacgccacaccttctttcagaactcgtactgctcagaccttctttcttgaagtttacggtttgttcttgttcattcatcaacagagcttgcgagcaccggtgagaaggagtggtacttctactgcccaagggatcggaaataccgcaacagcgtaagaccaaacagagtgacggcagccggtttctggaaggccacagggacagacaggccgatctactcctccgagggcaccaagtgcgtgggcctgaagaagtccctcgtgttctacaaagggagagcggcgagagggatgaagaccgactggatgatgcacgagttcaggctcccttcgctcgccgatccctcgctccccaagcgtccgatcgacaagaccattccactcaatgtaagtagctagcgtctgcaggcaatttcacattactgtacagtccaagagctagattccaaacgtggtttttggcgcaagcaggactcgtggactatctgtaggatcttcaagaaaaccagttcgctggcgcaacgagcgctgtcgcacacctgggggcccccactgctgggggcaacagaggcagatgatatgatcaacgcgttgcagtcagtgcaggcttcagaattcgctctcgagagctcactgcaggttgcaccggctgcgcctgcagcaggccagttcagcagcaggcatggcttgcatgttcatggccagcaccagcagaagaagggtaccaacagcccgtctctggacggctcctcctcatgcaagctcatcaacttcaccagcagcagcccatccgaggagggacgaccccagagcttgagcttcccagtcaccttcccctttgaagtgcaagggacgcacaagactgcagccgccgcgccagtcttcttcggcgcgcatcctgatcatcacctcggtgggttcgttgtcgactcttctgccgatgtcaatggcggcatcgtcggtggcaggagccaggactcgtccaccaggaagcccagcaataatggcttcagcaccagcagcggtgactgggaaactgcggggagggtcagcttcccttttgatctgggtgcagattcttcagaggagtggaggtgcaacataccctgggagtccttgctgaccccggctgctgtccaggctgagctgctgccacactagggcagggcagcggcatttagcaattgcattgcattacggagagtatctcataggtttacatgtacagtctacaggtgctgtgagtgtgagtttccttcatctgttagcatttctgttagctgcagaaacatttttttttggttcagttttggttaggaatgccatgtacataccacgagctatgtagcattgttaacagcaaagctaacagagagaaggaaccttgtgttgtacgtacactattcagctctttgaatacttcagtgcaagtttgaatactttattgcgtcaaaacactggggccagtctgcattaaactacattttggactggtacctcccattgaactacaatcgatgaaccaaatacgccctccgttagcatttctgttaggcgaattcttcagttttggctacgggagccacgtacacagcctggataaaattgtgcgcatgtttgagaactttatgattatgataaatcgacaaaataaataatacacggccacactgcttgcatagatatgaatgggcatcaagagcaacaacgagcaacatggacaaaagatgttacaaaccagaaggttgatctttgcatagataggatctgaattcataataaaagcaactaggggaacagattcccgatattccaacaattcaaaggtgaaagggattcagtgtccagaatctctaaactcacatgctaaatgctcaacaaggcacctagattttccatccaccaaaattaattttcgcagtgtacaaaacagggctaggcttccccattcctggagatttactttgcagctgtcttgtccttggttttttgtattttcaggaccttcttgacaatcttctgctcctcgaccaagaaagcacgaatgattctgcatacagtagttgtaattcataagactacgaaattacagaacctggacctccacaccacaatatgtccaccccctatttactcacctctccctaacagcaattccagagagtactccaccataaggacggttcacagtcctgcggctcctaggcaacctggaccttttgtactcagcaggcctcaagtgagggatctggaaatatggaaacaatagcattaaacaatattaggtggaaatatccaatgacagatgaatacccagttttggtgacactgagggcattgttcaggtagggagggaaattaccagatgatgattactatggagaatattatgccatggaaacaaccaaataaatagtgcaagcacacatagaagaaaaaaaatagcaaaatgcacgtatattgctacagttcccttttatgttgattatagaatataaaacacaaagacacaaagaaagacatgtgtgttttgttggctaggcgggtgtggttgtgggtttggagccaacaaccatggttcaaatcacc

SEQ ID NO: 476 - protein, 392 aa, Zea mays
MEERNGTNMEKSDEILMPGFRFHPTDEELVSFYLKRKVQQKPISIELIRQLDIYKYDPWDLPKLASTGEKEWYFYCPRDRKYRNSVRPNRVTAAGFWKATGTDRPIYSSEGTKCVGLKKSLVFYKGRAARGMKTDWMMHEFRLPSLADPSLPKRPIDKTIPLNDSWTICRIFKKTSSLAQRALSHTWGPPLLGATEADDMINALQSVQASEFALESSLQVAPAAPAAGQFSSRHGLHVHGQHQQKKGTNSPSLDGSSSCKLINFTSSSPSEEGRPQSLSFPVTFPFEVQGTHKTAAAAPVFFGAHPDHHLGGFVVDSSADVNGGIVGGRSQDSSTRKPSNNGFSTSSGDWETAGRVSFPFDLGADSSEEWRCNIPWESLLTPAAVQAELLPH

SEQ ID NO: 477 - DNA, 4113 bp, Zea mays
cgacagtaaagatagatagaaaaagtagtgctgtataaagttttttttctcttaaaaaactacaaaagagaagtaacgcgtacaacatgttttcgctgtcgctgcaagttgaagccaagagagaatatatatgtggtttgtattgtacgtataagtatccctggacggatataggcgtatgctaaggtatttgccgtgtcctgttttgctataaaataaaaaaaaattaatggtgttatgagcggcacggttgagtctgctattgtctttggagtaccaggcaaatgagtttataaaagtagaataaaattatgtgtattgctagaaaataggctaaatttatgcgggttacttgtaacaaaaaaatctaccctttttgcaaatggatagataacgtcctattcgaattcgactcgtcaaatagaactgagattcgatatatatccaagtctgtatattcagtatcatatccgtgtactaacgctagatatttaagatatcgatatctaattagttttattcgagacaactaataatatcttttaaatttaaatagaaaatataaaaaatatatgactatagtacgattacatccgtagttccctacccaccttgtacgtttaatggtggtctcacatgatagatagaagtgctccaacatggtgatgtgatatttttgtttcgttacgcgccgaccgcgacgaggccgaccgtgccgagaagacaaaaataatatcagtcggggcggtggccagccgtgtccttgtatccgcggtccgcggacccgccgcctcggccccttggtgccttggtggtggcgtgggcgtggtccatggacctggcgcacacacgcacgcacgccccagcgggcagcgcccacccccgcgccctcgggccccgcgcatggataactcgtgggtggggcccagccaaccccccttccgcccgcagattttttgcgagacccgtcggctcggcctcggcgtgcaagaaaccagaccaacaacaaaaaccgactagcccaggcaagcagaaacccactgtctccgcttccgctcccgactcctttgtctcgtcctcatccatccaaccaggcgagccaacaagcaagcaaaagtaaacggggcgaggagctggagagacgccggcgacgcgaagcaaccgcccgatcggagccgcggctgagcaggagggagccggagatggtgggtctcgtcggcggcagcacggcgcgggcggagcacgtcgtcgccaacgccggaggggaggcagagtacgtgcgccgcatgcaccgccacgcgccgaccgagcaccagtgcacctccaccctcgtcaagcacatcaaggcgcccgtccacctcgtatgtcccccctccaccccgctctttcctaccctcaacgcggctggccccggtggttcagcggttggactgcctcgcgtctgggctgctatttctcttcggatctggagtcaggagtccttcgtccgatttccaaggccttgttgggtgtctcccccccaccgacgtgttctcgtgatgttgggttaatcgcggctggcgtcaaatcgattggaagctgacgccgtcgatcgcatcgcaggtgtgggagctggtgcggaggttcgaccagccgcagcggtacaagccgttcgtcaggaactgcgtcgtgcgcggggaccagctcgaggtcggcagcctgcgcgacgtcaacgtcaagaccggcctgccggcgacgaccagcaccgagcgcctcgagcagctcgacgacgacctgcacatactcggtgtcaagttcgtcggcggggaccaccgcctccaggtccgtgctgctgccgcccgtttgttgcgtccctgcaaaaatgctctgtttcacgcgccctccttgcttgtcagtgtactccaaattatttttgggggtatgcttgctttgttaccatttctcttttttttaaattaaattgctttcttgtttccatttcactgcagtcctgatcgctggatgctatgcatgaaatgcatttgctgtgcttgcgagattgggcatttactatgagctttgtgacagttaacatcttggtcctgtttggaagctgggattgggaatcaaatccttacatggtttaggagcatccagtttgaacttaaaccattgtagacatctgctgcaataaaaacaattggcttcggtgagaggcactcatcatcagttcaaacttaaaacgagataagccatcggttgattggcctaattaccttgcttcccgtgattgttcgcctcgctgaaaggatatgctcacaacccgtactgttttgacttgttatccacatactatttaagtacgaaaggacatgcgtactactttcatttgttgttcttcgtctagtcttcagactgataatataaggtgaaaaacttcgatgtttcgcgtgctgtcaagtgattgtgaagcaaagtttctgttagtgtcaatgcgtacaggctgcaatggccatctttactcctacttgaagcatatctctgatccacactgatgatgatgagttgtgtgcgccacttttttttctttttctttcagaactactcatccatcataactgtccaccccgagagcattgacgggaggccgggcaccctggtgatcgagtcgttcgtggtcgatgtgcctgatggcaacacgaaggacgagacatgctacttcgtggaggccgtgatcaagtgcaacctcaattctctcgcagaggtatcggagcagctagcagtggagtcacctacgtcgctgatcgatcagtgaagtcacctgcgtcgcccatcgatcagtgaccaccggtacaaaaaaagacgtcaatcagcaacaaataagaagaagcttcgaaggctggctggagagttcaacctttttgagaccggtggtttggccatcgtcttctgcgtgtaatgtctcttggaatatggaagtattagtcgttgtgtaggattaaacatctgtagtagcttgtatgctagggatggttgtttagccttagaaactgcacctagatacctcatggcatgtatgcatactgctagtatgtgtagagatcagggaaagcatggagcgggttttgcctcttaggtgcatggagatctgtctttttttccccctccattttgcggtggcgactctattggttggggttcttggataaatatactttcccgcgaacgcatagggccggattttggaattggttcaattctcgtaattattgtattctctagtgttattgggatttggggtttggaattgccggactgcgataagtgatgaaaatgtagacattaaagctctcgatgtcagatataatatgttctatgataatactcgatgttagataatactctatgttctgccaaggggacagctacatgtttgagtcggttatatgctttctagcataactaaggggatttgagtcggttatatactttcaagcataactaaggggatatttggtttgagtaatcacttcattcaaattgagatggagtatctatggatggtcaataagtacgagacccgcgagcccgtacgaagcctgctgtttgggcctgatccgagcccggcatggcctggttctatgcgggcccggcctagcacaaataagtggaacaaataagtggcacaaataagtgtcccataagtgtagcattcgatttcataagataaattaaatgcaaataatcaacataccgagatcgaaaccacatatgcagcgattacattaatgttataccattgcacagtgcacaaatataaagagtattaaataatattaaataccattgtcttaaacatagttttaccgaaaactaaactaaggaaacgaaagataacactcctacacagacatattagttttaattaacctaagaaataaaacttctaagaattgttccatcatcatatccaaaccaaaatatatctaatcaaagagagaaaccatgccacaattaactatgatcataattgatatattagttttaattaacactctgtagaagctgtactcttcacccatgagttatgattcctatttgccacatgttgtacaaaccctttaacacttctgg

SEQ ID NO: 478 - protein, 197 aa, Zea mays
MVGLVGGSTARAEHVVANAGGEAEYVRRMHRHAPTEHQCTSTLVKHIKAPVHLVWELVRRFDQPQRYKPFVRNCVVRGDQLEVGSLRDVNVKTGLPATTSTERLEQLDDDLHILGVKFVGGDHRLQNYSSIITVHPESIDGRPGTLVIESFVVDVPDGNTKDETCYFVEAVIKCNLNSLAEVSEQLAVESPTSLIDQ

SEQ ID NO: 479 - DNA, 3193 bp, Zea mays
tattcctacctaatatatcaggacggtcttattaataattctaatgagttatcttggaattttgaatcgaatcaaaaaatctatattatgctcactcaaggaaagtagatgtagataggggcttatatcggtggaggatgacagcgcgccgccgggtcggatccacgcgcctcctcgccggatccgcgtggcttcgccggattcgtgagtcgcctggccggatccgcgcgtgcccgagccggattcgcgagccgccgggctggatccgcacgcctcctcgccggatccgcgcgcgccggcgtgggagaggagagcggcgcgccggcccggatccgctcgacgccggggaggaggaagagggaaggaggcgcggtggccggccggagggaaggaggctggggaggtggaggcaaggcggaggacgaagagcgagcgggtggaggggaggcgagcggctgctgtctgccgcgggggaggcggagtgccgagcggggaggtaggtaggcagggtaggagagtgggaaaaataatataaaacgtgggagttggtatagagttgagatgtagagtaaacatgagcgcagggaattgttgtatagagtagagaatattgctgattaggacgaaatattctttttagagtggatttttagagttgaatgagtgtggatagccttatataaaaccccaaaagtagtggaaacgatctaaaatcttccacgacgtgaccagcacgtggagtcatggacgggacgatacccccgcccctcaaaaacaaaaggtctcgtgggaatcagcgtcatggacagaagatgcttctgccccgtttcttctgccccgttcgcacgttcaagggccacgcacctctccgaaaaatcaaagcacagcctcctgtagctagccctagcttgagtctctcccggtctcccctcacctcacgctggttgcctatataaacgaagatcagatctcgcaccggcgtagcatcacacggggaacacacaaaacatactcctgccgaagcgctgagaagtagctagacaagaataatggggttcagtgaggcacaggaagagctcgtcctccgttcatggaaagccatgaagagcgactctgagtcgactgctcttaagttcttcctcaggtgtgtgatgacactacgtacattcgcgtgcaatttgttttccatggcatgtgtttactctggaaccgtcattttctttcgtgccatgctaaataaataaataaataaaaacaggatctttgagatcgcgccgggtgccaagcagatgttctccttcctgcgcgacgccggcgacgcgccgctggagaaacaccccaagctcaaggcccacgccgtcaccgtcttcgttatggtcagccacctcgatctatctctgtactgtacgcatgtttctatcctcatctagctacctgctgctttgctttaattggcgtccaggcatgcgagtcggcgacgcagctgaggagcaccggcgacgtgaaggtgagggaggccaccctgaagcggctgggcgcgacgcacgccagggcgggcgtcgccgacgcgcatttcgaggtaacttcattaacacgtgtttctatccatggggcgcaatgaacctctgcaagtgcaagctcgatggcacagattatatattccagcgctcgcaagtgtcgtcggttgcagtgagtgagctgtgagcggtggcgattgacagacagagacccaccggtcttgctcgtctttaaacgtgcaggtcgtcaagacggcgctgctggacaccatcagggacgcggtcccggacatgtggacgccggagatgaaggcggcgtgggaggaggcctacgaccagctggccgccgtcatcaaggaggagatgaagaacgccgccgccgccgaggagcagacgaagaacgccgccaccgccgcggaggagacgacgaacgccgccgccgccgaggaggagacgacgaacgccgccgcggctgttgatgcttcctagctcctagcctagcctcctgctacgctcctctgctagcgaccgtggcacgcgcaccgctgcgttaatgggtgtttttggactgctgctggcctgatacctaactacggagctgtcgctaatgctgctgcatttttgtttgtcgaccgcatcatttttgtgatgatgaataaaatattcagaaaaggcccgtcatgcgagtgaaatttgactgaacgtcgtgagaatttaaggccgaaacagtgacatctctagttgtataagtgttggcgctgatttgggcgccaaacactgaaacaaactatctagcggtgctctctgtggagtcacggacactccgcgacatagggtcgtatagtccgcaacttgggcaccggtgcacgcttccgcaaccgagggtcttctttttcgcgaagaacactagaactcaccctcgagagagatcccttcgagggagagagttctaagatattgctccgggtcagcaggtcgcccgacacttctctaatcgatgtagagtcgaagagagattttgtgaagactaaactagatgtaaaactaaggcttgattacttctactcctaaattggaagaacgatgcaaataaggtaaaaattgataaatagttttaattggatcgattgtaaggggcttaaatcggttgtaacccttcgtctatataaagggagggaggtctggacccgttataagtcggttcccgagttaatcctgcaggtttggctaacaaatcctactagaaatctcgaaccctaactgtcggagagggaattctccggccgggtggcggaacgcacccgccataaatcctaagatgaggaggggcctaagcgttttgtctgctgtctagatggatgatgaacacaagaacacacaagggtttagagtggttcggaccgtcggagcgtaataccctactccactgtgtgctgtattaagcttgagagactaagttggatctgccttgtatcgttgtgtgtcttcccttttatagctcaaggggggcacgtacaagggtgctgagccccgacatgtaggcccaggggcaaaagggagggaatacaaatagaagtatccaatgccagtgtcacctagaagatctctaagcgccctaatgtccgtagtccatataatattaatatctcgcggctgcttcctcggtaacgcgcggg

SEQ ID NO: 480 - protein, 191 aa, Zea mays
MGFSEAQEELVLRSWKAMKSDSESTALKFFLRIFEIAPGAKQMFSFLRDAGDAPLEKHPKLKAHAVTVFVMACESATQLRSTGDVKVREATLKRLGATHARAGVADAHFEVVKTALLDTIRDAVPDMWTPEMKAAWEEAYDQLAAVIKEEMKNAAAAEEQTKNAATAAEETTNAAAAEEETTNAAAAVDAS

SEQ ID NO: 481 - DNA, 8143 bp, Zea mays
ctaagtaattaactactactaactagctaacttactgatcatttactagcaatataactaaacaactttaagtttttagtgtataaaaagacacatcgatgcctgggtgggggagtggcccgtgcctgatggtgcagaggctagggcttgggcagagagagcgaaagaacacgccacaactacatgaatgagacttgggcgttaggatctatagcatcagcctcgatgccacgagctatgaaacaaggtattgtcatgttaaggtcacgatgacatctatactatttaagtgtaatacaagttgctataatctaggataccaaaccatatgacatcatcgtcatatatcatcatctcgatccttggaattcaaatgtagtattagcctcatcaaagatataaatgtaaaattttgataaaagaaaatggctaaaaaaatcgtcaccgtgcaccgcacgcaccaactaccccttggcagggcgatgcgtgcgtagacggtttacgagtcattccgtacaaggaaaaagtcatgcggcggtgatgcaggacctcatggggccagactccagaggcgagcatcggatcctatcgcttgctcgcctactcacgtcttgacacctcaaccatgcaggctattcagccatgcaagagctagtacgcagggttcttccagccggccagtgtagtgtagtgtaggtgctcctgtgacactgttcgcgcgtttggtcgctagcttgaggcaaaatctggcataagatttggacacacagtgccaagcacgccacggcaggctagtccaggtagcaactgtagccaaatctgcaatgcttgcacggtactactggctcgtgaacagaatcgagaggggtccgtcgggggaggtttggccactgggcactgaccaagaaagagtgatgactgatgagtgagtgagggtgagcgaggatgctgaactgggctcgccttctttaacactgcgaaatggtggtcccggcggccggtttccaatccaaggatggagtattaacacccctctctctctcactgtcacagacacatccccttggtgctacggccaccccgcgcgctgtacctggtcttggcttgccgtgtttatttatatatatatgtaggcaccccccagcccagctgccgctcaaagcgacaggtggagatcggagggaggaagaagaactgagctgcggatcgagggaagggaacaagcaagcagccagagccaggtcgtggggagccggcggcagtgatcttcttgcgtcgaaggcgaggccggagcgtcggtttgagcgctcgtgcgatatgggggagcaggagaacaacaagatcggcggcagcggcaacgacaacgccatggcggtggacgaagcgggcgcgggcgcggccgcgaacaaggggaagagcctcggcgccgcggacccgcgcctgcaggccatttccgacgccatccgcgtcgtcccccacttccccaagccaggtccgcccccctcgtctccaactccaacgtacaatcaatcattcggttgactcggacgaaccgcacgcgcggcgcggggggcctcgactcgagccctcgatcgggcgcgcgcacggcgggagcacacagttcattcccttctttcgcggccgcgcctcgtgcgcatgcagggatcatgttcaacgacatcacggagctgctgctgcggccgggcgtgttcagggacgccgtggacatgttcgtcgagcgctaccgcggcatgggcatcgcggccgtcgcaggtaagaccgaatcgggaaccgctagccatcattggttcaccatggtaagcggcggagccgccgcctgcctgcctcgcctgcctgcctaactgccttcgccttcccttaatgaccctgcggccgccgctcggtgctgtcgtcaattccgcctgacgctgggggcactgggggctggggcgggcgcggcgcggtggtgttctgagattccgtaatatctttggggcagatcttccgtgctccttttgtccccccacgctttgtcgttcgttcgttgtgatcagccgatcaggtcatgtcatcactcaccaccaccaccactaccacctccccacctacgcgtttctttagtctctcgcctactacagtctactgctcttgctctttacagcaagtaaaaaaaaatttaaataaatcttgcagcagctgcatattctgcacagcagttgggtactaggcgagttcagtgttgatagtaccaagtcctaaaatatgctgataccattctagcagtacggcctcaccatctgacgttctgggccctgggtcataaattcaggggtccaatgccgccgagctcagctgtgacttcatgaggacaggtcgaggaccgtctgctcactagtcactacgtctacgtacgtgcgggcgtgtgcgttggttgatggcaatggtctcgctcgcgtcagagctgggccgcgccgcgccgcgccacggcgtccctgggtttttgtttgccgcggttcggtggtccagcggaatcccgcgcattcaatgcaaggatcggagggcatgtcgacggccgctgattggccgggatcggtcgatccacttcagctcggcgcgatctcatgagtagcgactgtgcgagtgatgcgacacgcctcgtgtgtgccggggcggggcggggaccggcgcggcggcgctggtggtggcggactggcgggcgccgccgcgatcctcttcgaacggctgcggtcgtgcacatgcggtgtcggctcggccccgtcctcggacgccgagatgtggtcacgctttccttgtattttttttgtcctccactcctagtcctagctagtcctgggatctgcgctgcgcatggtctggtctggtctggtcccgtgcgggactctgcatgtgcacagtgacctcctgttggccttgacagctgccaaagtagagcatcgcttgtgtttgtgtggtgtggagtgtggactgtagcgattcgctaggaggatttacttcatcttcttggacacaactggctaggacgacctctattttcatcctttgaattttgacttctcttctattacagtcattattaccgttttcgccttgtcgttactccctccgtttctttttatttgtcgcactatccagcgacaaataaaaagaaacggagggagtactttagaagttacccttttgatcacatgaggaacgtcgtctgagtgttttttaccgagcatgctcaaatgtaacttcatattctcttctcaaacttaatcatcatcatgtaactaattaattcttcatattttgctaggcattgaagctagaggattcatctttgggccagccattgcgctagccataggagcaaagttcataccactacgtaaacctaagaagcttccaggtgatgtgggtggagaagtaaatacaaacaaaacatctataaattagaccccacataattttggtctcgacagtgctgaggaagtggagggcttcggtatcttgaatgtcgtatttgcgcccgtaaactttttaactccgaaaatgaacatgacaacaaatgctacagactgtacaccatactatcatgccatatatagctaccacattggcgaaagcaattacgatatatatggatatgtcgcttttaatttcaccgtgaaacccaatgataccaatatatgccacatggtaaaaagcatgccattggactgttactttgtggaagtatcaatatataaatgcatatttactgtaatttcttcgaaagaaaaccgtaactagctagctagacccatttaattaaaaaaaactagctagagactatttgttagtgtgcagtttcgttacagtttcaacatatagtagtgaatagctgttgcttttataacattacaggtgaggtattttctgaaagttatgtacttgagtatgggatggattgtttggagatgcatgttggagctattgaacccggggagcgcgtagtggttgtcgatgatttggttgcaactggtggaactctttctgctgcaataagacttctcggttagtaccttattacatgccatgtttagtatgatatatatttattggaagctgaccctagctatacatatataccgttcgtttagttttgaatatgatatatatgtgaatgcaaaccttcaactttgtatggttgtttattagcattcgtgctctaaatatgtaataaaatcagcataaaaacccggataggtgtgacacatatattatattcctggttgatgtttattgtctggtagtggtagtactattaataacgggagacctaaaaaaaatactgctattgcacttatatttcttctgacataatccctgtactttaggaactttccccacttgttcacacgtagatgctgttcttacttgtttatggtttggctttgtgcactgtggagtatatcagtgagtattagaacaaaccattagtgcacagaaatcaagcactctgtgctcttcaatcaaccatcagctgctaatttgatcatgtgacaatgcatgtgttctctctcgaaagaagggaaacattttttttccgacatgaaacttaaacctatcactccaggtttcttgttacgaggaaacaatatcttttcaccagtgttctcgatcttagaacgagaaacttaaaggaaaaaaagaagtcatgatgaagagtacagatttataaggtaaaaaggttgattaaggttatacacttgcgtagtagttcagagattgttgcgtaaaaaaggtgtgacgtgtatcttgtggagggcatcatgttcttttgactacaaacgaaatttgtccttaagcgggacaagctgtttattcatcataggacaaagtgttgtctgaatgatatgccctatatggggtagctaataactattggcatgatttcaatgagactggatgcacaacctcatttatttgatgttacaagccaaaagtttgttgataggaactgagcactcatgtctcatataacaagcaaacaagggataccactatgttagaagttttcaactatgttccattcctcttatttttaccaaattaaaaaaaatgttgttttgtgtggactgttgcatgcaattgagcttccagtttcatactagctccatgactgctgaaattctttgcttttccagagcgcgcaggagctaacgtggttgagtgtgcatgcctcattgggcttcccaagtttaaggtaccaaaatctaagttcgttcaaaaaagctaccaaatgtatatttcttttttctcaaggtgcaccaatatgctccttacatgcacttcagttagctaaaggaaattgaggaagtattccatctcggtctgagggaggaaagacgcaatagaacaaggccagtgtaaaaaaaaactagtctgcctgtaactattcctgtacatgtgactgcagatttttaataaatgaaatggtatcatctagccgatatcttttcctcctacgagtaaaaccgagagcaacctcagcgtgtgtttgaaaacaaagtattttaaaaaccatggtgttttgaggtaaagtatctcaaaccatggtattggtatgcatgtgcaagaagctagttattcaccaaaactttgggttggagcaaagtttcaaatacttcaaaaatacatgctcagagttttttacaagtaggcaaacaaccactgtattctccaataacatgattttatcttaaaacaataaaactccaaaaacattttgcttcttaacaccctccttaaggtaaaaaaacttgtggatatcttttgtatgtaacttcagtgacagataggtgcatgtggttagggtaaattattttttgttataagaattatatgcctagtgtgcaatggtgagagctcaccgggacgtggggttcaaagcagcctcttcacatttgcggatgaaggtttgcctcagtttatttcttctccaaatgtcatttgggttttttctttcctaaatcacacatatggaagcgtctggcactggttatgtccttttacgtaggtgataagaatagcctaccttaatttataactttaaataccacgcgaccatgtattttttcctatggatgagatagctgataaccattagccacaacaaaagggatatggctaggttgaactctttggaatctagcatatgtagcaggacttgatatttccagatatgatgatagagagagggttgggaaactacgctagtgccatagtccactcaagtctgcctattcagtaaggatattttagatgcgaggatgactatttttttttaatccaaccttttcttatgaaagagaggcatatcaaggagtgtatatactattccctcatatctactgaggttccattttttttttcaatgtgcaggatttctataagctcaacgggaaaccggtttacatcctggtggagtcccgcaaataggacgcagtaaaatggtcagacaagtaaatgctctcaagctccttttatacttgaaacttctctcaacattcatttcgaacatatcatgaaattacaaagctatgcatgttcgcagaatcgagctttgcacattgagtcaaatttgatttcctggtgaaacaggagcagtagcagcggtagcgtccagccttaaagcatgcatggctactgacactaatttctgcctcgtgaccatttcagaaaaagctttctagcttcccgtccaaagaagctcacagcttcactcatttgcacgcgcaagcaaggtggtatgggggcaccgagaaactccgcagtaatctgtgttgaggccacggccagatgatgctatgtactcctatcttcatggagagggtgatggactgggtgaaacgtagtcactgtacttttgtagcacgtcatgtctagtgtttcttagtagccatggctgaagagagtttgtagcttattcccggcttcctgcagccaggaacatcagtgttagccagagaagctaggaaaaaggatcttatgttgctgctcagttttctaccagaatcgtcttcctttttttcccctttgcagaatcaactctttggtaaactttactaagctcgttttgcctaaacggccgttcaatcatgaagaaagagcaatcatacgtaatgccagcgtaaggaggacatgtcttttttccaatatattactatattcaagctcccagaatcaactctttgataaaatttgcatctaccttggtgcttgtacaccagactagcctaacaaagtgtcgcccctgcacttgcagatggttcccaaaccctatgccgtcgaaccacacttatctactatgtctacgactaatagttagatgacactatggtttctatatattagttgattatacattactatagtttttatatatcatatttgtaaacatttcccatgagtcaatgataggtggagtctatgatatatatataaagttgtaatcttttaatgatatagatccaattatttctttattcaaacacgattttttaattttcaaattattatcatctaccttttatataacacaaagtagcaagagctgtagtggttaaggcgtggggcttagatccttgcatcctgtgtttggatcccacttgtctcattttttttttataattccgggcggctggataagcgccaggtgggagcgacacaaaaaccactgatggcgatgtctaacgttggtctggcacccatctacttaattcttctgtatctgtatgagtcgtgatcatgtgttagattttgcttaagatcctatgtacatttgctatatgtttatgtaccatatgcttatgctaagatcagttttgacacttgcatgtttatcaacgacacgtggaaatggtggaagcctgtcacagaagttcctagcaccctgatccagtgatccctgcattgttccatgaatatcctcctctcacttggagcctgaagggattgaaatcgaatgaaaagatgtacaccaatatatttctccagcaagagcattagctgcattacacggttacaatacaacttgaagcaaatctgaactcaactataatacaggcgaggcatggaccagcgtccggatgcaatg

SEQ ID NO: 482 - protein, 214 aa, Zea mays
MGEQENNKIGGSGNDNAMAVDEAGAGAAANKGKSLGAADPRLQAISDAIRVVPHFPKPGIMFNDITELLLRPGVFRDAVDMFVERYRGMGIAAAAGIEARGFIFGPAIALAIGAKFIPLRKPKKLPGEVFSESYVLEYGMDCLEMHVGAIEPGERVVVVDDLVATGGTLSAAIRLLERAGANVAECACLIGLPKFKDFYKLNGKPVYILVESRK

SEQ ID NO: 483 - DNA, 3325 bp, Zea mays
ttctagaggctacaataaataataggaagttagctgattaactttctataggccataataaattgtaggaagttacgtggctaacttactaagagactacataagcggtagtaagttagtgggttgacagcgctcgactcctagacgacatgaacgagttaacttccgagaggcatagttggctctaggtaactttctagagggctctaaaaagttaaactaacttcgaaccataatttttcgaaagcttaacttctgatgtgatacggtttcgttaacttccgagaatttacggccaacttactgctctacaaagttaaataggctttttagtgtttgtaacatcacgtgtcagcatcagacacgctcaaaaatccatgtataggagatcaactcctgacccatgatagaaaggtcactaatctcgaacttctccactagctgcggttcaggcaaaggtactcctcagtaagctgtcaccatttcaaaaagcaaaaagctataatctataaacaaatacgtgctttcaaaattgtacttctcaaagccattattccgaaaaaaacatctcctgatttttacctcttagtagagttttgattttctcagtgaaaaaaaaaacagctttaaaaacccaacaaaacaccttttattttgagatgtactagcgagtaaacatttttccttccgtaccacgaccatgacacggctctccgccccggctctccgccaatcgtcccatgtgctgccaccttggcgacccgagtgaatccttcacgtacgtgtgttgcactgcaccatttccaaaccaccgaagcgaagcgaccagaagcctgttaccccccaaggccaaagcgatcacggcgaccagcgagacgacgtgtgcggcaacgcgccacctcagccggacacccgtcgccgcgccacccgcctcgctcgaacacgcgtccaaactccaaacccgtctcgcccataaaaccctccgctccccacaaaacccagcacgatctatcacgacgatcagcgcgtatccctgacaaaagcacacagacagctcgtattcgcggctgcaaagctcgagctcagaaagatcagcaatggcgtttctctcgcggtcgaggagccacgctgtcccctcggcgctgctggtgctgctgctcttgtcggtggcctcggcggccgcggtgggcgtggcggccaagacggacgtccacgacgtcgcggaggagagcaacaaggacgaggagtcatggacgggctgggccaaggacaagatctccgaggggttggggctcaagcaccatgccgacgtcgacgaggaggagaccgcgcgcaaggctggccacaccgtcaagtccgcgcgcgagtccgcccagcacaccgcctccggtaagaactccacggtgccccaccattcattcattcgttcttctcgttcgtgctatgatcgtgctgacgccggccaagtccatgctacagagatagggaagaaggcggggtacgccaaggagacggcgggagatgccgcggccggcgcgtcgaacaaggccgggcaagccaaggaccaggctaaggacacggtgaaggacgcggccggcgaagcgtccaacaaggcggagtacggcaagcagaagaccaaggaggccgccgaggcggcgagcgagagtggtgccgaggcgcacgagcggtcgaagaagggcaaggccatggtcgaggagaaggcccgagagaaagccgggcaggggtacgagagcgccaaggacgcggccggcaaggcgcaggagacgctgagccagaccgcggacgcggcggcggagaaggccgggacggccaaggacgcggcgtgggagaaggcggacaaggccggcaagaaggcgcaggagtccaaggaggcggccaaggggaaggcaacggagaaggcggcgtccgccaaggacgcggcgtgggagacggtggaggcggccaaggagaaggccggcgaagggtatgagagggtgaaggagaaggcgcgggagacggcggacacggccaaggagaggctggaggaggtgaaggagagggtcgctgggcccgacgtcgccgccgtcgacggcaaggggaagcaccggagggcggacgtggacaagtaccggtcggagtcggaggacgagctgtgaggagagcccgccgcggcgggtgatgtttgcattcagtgtccaggtcgttttcagcgtgttcaaagctagttttttttttctttcctacacggatctgtatactagtcttctgtttcagcctcgaccatatgctgttcctgctcttagtacaataatctgatgacatgcacacaaacttcgcagaaattcgagttatacgtacaacaacttaatgtcatctattagcacaccaaaactatgcatatgtgatgtgccaacacgacggcatggcgaatattattacaaagtggcctgctttcaaatctaattggaaaaaaaactagtggcatttcccccctcttcaaacctaatcgaagaggattctaattgaaaaaaaaagcgagtgacatgttcctcttcaaatcaaatctaattgaagaggatgcgcatttcttctcccaacccgatcgacatccaccggtttcttcagtccgtcagacaagcagcggggcttccagtgcagtggctctcggagtaaggacggcgaagcaggaggggggatcaggcccgttccgtacctgctcaccgtgttgaggccccccgtctcgccgcagctcatcgtatctgcagcggaagacgacggtgttgcgcccgcccgatcagttgccggccttcgcagcagaaggaaaaacacaaattttcaagcatctctgccgatctcggcgtcacttaccttcgtacgattccagggcaaacagggcgatcccgcagaagatcttgtccaggaagctgagggagcagtagacgaaggcgcagccgttgaggtcctcccctaccagccggctctccagcccaaccgtcgtgagacctgcccatgtaatgtaaagccagagcacgcgaaaccggtaggatttggacgtgcagcgtggcgtgctagctaggcgcccgcgttttaccatgacgagcgcgttggcagcgccgatgaccatggcgagagggtgttgtgcatctggctcgggaagacgaagacggtgacgccggagatgacccagagcgtcgcgccgacggtgaggagggacttgaggcgccggtcgttccacttgatctcctacgttcgaggcaggcaggcagttccagagatgggtgagtgaagggaaggctgaattttgcaatgcagtatattttttagc

SEQ ID NO: 484 - protein, 320 aa, Zea mays
MAFLSRSRSHAVPSALLVLLLLSVASAAAVGVAAKTDVHDVAEESNKDEESWTGWAKDKISEGLGLKHHADVDEEETARKAGHTVKSARESAQHTASEIGKKAGYAKETAGDAAAGASNKAGQAKDQAKDTVKDAAGEASNKAEYGKQKTKEAAEAASESGAEAHERSKKGKAMVEEKAREKAGQGYESAKDAAGKAQETLSQTADAAAEKAGTAKDAAWEKADKAGKKAQESKEAAKGKATEKAASAKDAAWETVEAAKEKAGEGYERVKEKARETADTAKERLEEVKERVAGPDVAAVDGKGKHRRADVDKYRSEDEL

SEQ ID NO: 485 - DNA, 14519 bp, Zea mays
cgatagggcgcgtcagaatagttatgaaggtcggttgttgatcaagttaatgaaggtttgaaactttggactaaatttgagatttatattgaaatagagagtcagatgctaggataacaaaaggacgaacgaattagaaagtgagagatgcaaatgaatctaaacatcccctatttcataggtcgaatgccaaggctttaaatttgaccatttttcatttttttatactcccgacaatttaaaatagctagctcactgtgaaatacaccacgtcgttaaaggtgatcgatatcgaccggttcggtcgataccaactgagccattaaacaagaagacgacaggtaactgatcgatcggtaccgacccaatggttcaatggcccggtcggtagaaccgatggttatcgaccgggccctaattcaacgtcgttggtactatcctgatcaatcgaccattcgatagtatgctacttactactagcaggaccacatcaataggagctgccatattgcatctaggctcgcatgtttaatactctctcggtcctaaaacttaattaattttcgattaaacatacattcattaattaacttatgaatatagttaatatatatatctgtatttattatcatttatttgaatgtgaatagaaaaaagagggttagaaaaaactactctgtcctaaaatataatttgttttagtttttaaatacatttattgattaacatatgaatgtattttgtttatatctattattatttattcgaatatggatgaaaaaataaaactagaaagaactatattttatattctgatgtagagatagtatattttagggcggggagtagtaataatttgattgaaggaaaaaaaatgaaccggggcctgacttcacgctgggcagtgggcactgggcacccaccgggcaccgggggcaggaccacattgagtacccgaaattaatttgctgcctggtgtgggtcaaacactaactcccggttgaccattccaacaggccccacccgctaacggcgacgacgactgcttccccagtgggagacctgcaatcctcagccacctgcccctccccctcccccatctccgttcacctcttcccctcttccctaccttcctgtattcgcggcgtcgagtgccgccgcccttcgccggcgccgagcacggagcaacgcaccaggtacgcccccccctctctcctccctcccttcctgctcctcaaaatcgagcaccgcaaaccaaaccctagtacaagctgtaattattcggatctgacccggttacatggtgcatactaactcggggtttctgcaaaaattatcgggtgtacgcgtgtacactcatgtcctatgctaggtccgcccgtggttccagcggaggtctcgctgattgttgggacttacggatttctcgccttttttttgtttctaaaagtttcagtacctggattcgaactgagagtggattacgaagtcatggcaaggttatgttgcttcggcgccggttgctccgatgtaagtcccacttttgatcggtttccgcgtctttttttttgggccacggatatactagcatctctagaatttttgtcaattacttttgtgtttcaatcactaatacaacaagatactgactttctcctgtttataagtcaaataaatctgaggtttctgttaaggtttagttttttctttatcctttcatcttatagctgaacttgaagtgaagaaaatattatgttgaagtaatatgtagtatgctcctttggcactagtaataacaactagtgaccaatattgacttgttggcatgaaataccattattatgctagcgtctagcgacacgagttgcactaaacataatctctccagtctccacctgtaagcgctccaaaaaaagatgttcatgagctgtcattattcatgaaacttgtgagtaagctaggagctctgcaaattgcaatctggcttgtgttagcacttcagccctcttgctgattgttctgcttgtatgcagttcacggggcaagggtcaatagcatccggtaaagggaaaggctgtcaagggcaagtcaagatctgctatggatataaccttgtaagagggatgacgaatcatccaatggaggactatcattttgccgaacttgttgatgtcaaaggaaacgagcttggtctttttgctatttatgatggtcatttaggggataccgttcctatgtatttacagaagaatttatttacaaatattttgaatgaggtaagttttaagcttttgtttcaacagctcttaatttgctagctgtgtggttatcataaccttgtcattctattttaggaagagttttggacacacacagatagagcgattataaaagcgtatgaaaaaacagaccaagctattctgtcacatactccagatctgggacaaggtggctccactgctgtaaccgccattcttgtgaacggcaggaagttatgggtagctaatgttggcgattcaagagctgttcttttgaaaggtggtgagcccatacagatgtcgatagaccatgatccgaatgttgagcggagtgtaatcgaaaataggggtggttttgtttcaaatatgccaggtttgtcctcattttttactctttaagcacgataccctgatttaattgactggggtgcctttttcgatatttggttcattgtcggaagcatttgaacatgtgaaatacacaatcttagtgaaacattttttatggaatcttattgaatggctattaggtgttggaaaaataaaaggtgtttactagccaagttcaataacataatttatttaatctttactgcaaaacagaagaacaagtctcccttagtggagatagctgtacatacagagagagcctcatgggccatatgggtctatagtagatggaccatcatacacttaacatcccccttcaaactcaaggtggaagtggaggatttgaaacattgagtttatcaagtgaagccgatgctgctcttgagtctgtactttaggcaactgacgctcgtgtcgcctcgctctggcggctcggcggcaaatcctagtcgcagccgccactgcccctccacctcgcctacggccttgccgctgctagagcagggtggcggcgcttcccgtgcgcccctgcaaggacagtggcggcgaggagtgctccccctcgctccgcccctccccaaccctaccgccgtgactcgggcaccagacctggacccaatggggagtaggcggcgtgctgactgtgccggctggcgaggcgacagaaggagcaggggacgattgcctgggcggtgggcgcatggcggtcgtggctagcgttgtcgtcctctagttgggcggggcgggtcagtgtgcaggaggactcggatgcgcaggtgagctcttggcgtggcggcacaaggtgcgggtgcttgagcctcgtgacgtcgtggtggccaggtattgcgccgacgacagtggcttgacgggtttgcacagcggcgcacaacaaatgacatttgtacaccatgcaactactcgacaatgatggtcgttcgtgaatctgtgacgacactgagccttggtttgcacagcggcgctgcccgttggccattggccaaagccatgcccgtttgcgggcagacaacggtgacgcatgcaggcgccactaggggtggtaatggatcgcgatccaaatgtttcttcacaattccttaggagaaaatcccttcaatgccatccaaacttataccaatctctgcaatgccatcagaatttatagcttcccttcaatgtcatcaaatttaaattttaatcccttgaatgtcatcgccgttagtttgaagctaacatcgttagttccatttaaagcaaatccctccaatgtcatcaaaatctataccgatcccttcaatgccactagaaattggttcgatctatttgggttttaaaattttcagaataaaaaatatggaattgaagggattttctcactgaaatatggcattgaagggattttctcgctgatatatctgaaaaaccgatccaagggttttgggtttacatgccctaactactatacgactgtattattaaacttgatcttatgcgtggaaaggagcaagcaaggaagcttgcttagaactgtactaaacatagcttggctaatggccaacgggcagcgccgctgtgcaaaccagggcccaatgtcgtcacggattcacgaacgaccatcattgccgagtagttgcatggtgtacaaatgtcatttgttgtgcgaccgatggagtcgtacactgttcacgtatctagtgttgtacactgttcacgtatggggtcgccagtccctcttactcctgccccacgctttgctctcgtacaggacggtttcctcaccggttgggttacccctgtgggctggataaaatactcatggctcgtcagcttgctcggttcgtggttagcttggctcagttcgtttcaattttgtcacaagctgaggtagcatcttagctcggtttgttaacgagtcagcttgagccaactccttagctcgaatgagctagcatttgtcatcaaaacaaagcatgcacttgtgtttctccagccctacctctaacaagcaaaaaaaatgagtcatttagctatttgtataatgaacaacatatacacgtgacatacaaaattttgtttccccaatagaaaactttgtggttatttgtttatatcgatttgacctattcggtttttcatatttttttccaaaattattaggaagcaaatagaccgaactaatatatcggagtaattttggggtttcaaaaagtatggactgaactttggtctatagattttttattctagaatttttaaaccctaaatagatcgaaccaattttagtggcattgaaggtatcggtatagattttgatgacattggaaggatttgctttaaatgaaactaacgacgttaacttcaaactaacgacgatggcattcaagagattaaaatttaaatttgatggtattgaagggaagctataaattctgatggcattgaagggattggtataagtttggatggcattgaagggattttctcattcattagggccctaaaaatattttaattcaaaaatgaatagagatagagcccgatcctaatccgatccgatccttaaattttctagtgtaaaatttagatcccattgtcacccctaggtgccactcctaccctactgagggtgtcgtccatggatctcccttgtcctccgtgttggcgtcctcgcctcggctttcttggggtttcacactggctagttggccgacaccgagctctggtggttggttcctgctgggttggtgcgtcggtggacgacagatggtggcaacgcgcggcggcttggagatcttcactgctctgttgggtcttcggaggaaactctgcctggattgttctaggcgagcggcgacgacatttcgacgacgtttctccttgttgtccagaagaccttcaatttgggtgtttgtcggcaatgtggaggcctttcgtcactccgcttggctcggtggtgcttgggtctttgtcgctctggacgtctgcttgcccccggtgttcggcgtagtggctccaggttcgtcggtgaagaataagagcttcctcgcgtggggcgtgtcgaggcttggcaatgatgcgcaccgcggtcttccttcttgtgtgccggtgtttgtgtgtaggcgttgtcgagtgtctttgatcgtgtgctgcccgttttgggaagtcggagctactcattctttgttgagctcggcaacgatgactcatgttgggctttttgtgtggagttgtcgttgtctgtggtgttgtggtgggccttccatcgtttctcttctatgcactctgtgtaggttttgagcccggtttttccttaaaattgggtcaattccattcttcttaattgagaatcagagctcctgccaatacattcaaaaaagtatgtgctttagtgaaaaagtcaaccaattgcaactctgagggcacatactgaagagcaatggttttctaatgacaatgagaccgagtaaaaagggctcataaaaaacaatatgctactcattaatagtattatgtgaagcatcaatagcaggctcatcatgattgtccaaggtggtgaactagatggaagaacagtagtgtctttgggacgacggttgagaacatgtgttttaggtggtttggaaaaaggagtgaagtggcagaggtggaggaggtggcggagatgaaggtgttacatttgtaggtgacatgatgaaaatagaagactcaggaatgactgtattggacggagaaggtatgttgacaacaccactagatgaaacaggaggaaggtacggaaattatgtggactctgtgggtgagtacgagggttgagtggaggggttgtgaaagaaaggatggttctcaacaaaggccacatcacgagagatacgatgtatgaaacacaaagaaggatcataacaccgataaggcgataacctttatgctcaaaatatggccaacagattgtgtagtcaacttagtacgctcatgaggtacaagcaaaacataacatgtacatccacaaactcttagatgatcatagctcgtagggttatcaaaaagaacatcacatttgtctgacaattttgaagacggttgtctattgatgagatagacaagtgtagaaacaatttcatcccaaaaatgagaagggacaaaagatgaaatcaaaagtgtattagctgtgcctgtttctataagatgacaatgttttcatttaacaactcagaggtcagagaggatctctcggaagcagaagaacaactctcctttagtggagatagctgtatatatagtagattcttcatacacttaacaactgctagtcaaatgaaaatgtttattgaacaacaccatgtggtactctattccaagtatgttttgatataaactgtacgtgacaattcatatcatatttaataaaaacatacattttatagcaacaaagttgttgctaatggcttaatgattgcatttcaacacgctgtactatgccactttgatgcaatgcaattttataagcacattttcagtattgtatctgatggaaaatattctaccaaagcagcctataatggactatttattggacccactcattttgatcactgggagcgaatttggcattcctgggagcctcctacaacaacaacaacaacaacaacaacaaagccttttgtcccaagcacgttggggtaggctagagatgaaaccccgtatgaaaacctcagagctcaacccccaaagaaaacaggggaaacaaaggcaaaggagaaccgaaaacgacgaaacgggggaacacataaaagagataaaacccacaagaaccagcaaggtctaaatgagcacaagaaaaggtcaaacgattaaggaggaaaagcggaactataaatcaaggttctggcacgtgaattgcacacttccaccccttcctatccacggcgagctctttatcaatattccactccttcaggtccctcttcactgcctctgtccacgtcaaggttggtcgacctctacctctcttcacattctcgggacgcctaattattccgatatgcactggtgcctcttcaggtcttcgttggatatgtccaaaccatctcaaacgatgttgcataagcttctcctcaattggcgccactcctactctctctcgtatgtcatcattccggactcggtctctccttgtgtggccacatatccagcgcaacatacgcatctctgccacacacagttgttggacatgtcgtcttttagtgggccaacattctgctccatacaacatagccggccggattgctgtcctgtagaatttgccttttagtttgtgtggcacccgggggtcgcataagacacccgccgcttgccgccacttcaaccatccagctttaattctatgactgacatcctcatcgatgtctccatccttctgaagcattgatcctaagtaacgaaaagtgtctttcttgggtaccacttgcccatcaagactaacatcgccatcttcataccccatggcactgaaatcacacttcatatactccgttttagacctactaagcctaaaaccttttgcttccagcgtctgcctccacaattccaacttttgtgaaacaccactcctactctcctcaataagtaccacatcatcggcaaaaagcatacaccacggtatatctccttgtatgtcccttgtgacctcatctatcaccaaagcgaaaagataagggctcaaagccgacccttgatgtagtcctatgttaattggaaagtcatcggtgtccccatcacttgttcggacacttgtcacaacattagtgtacatatctttaataagattaatgtactttgttgctactttgtgtttttccaaggcccaccacattacactcctaggtactttgtcataagccttctccaagtctatgaagaccatatgcaggtctttcttttgttctctgaatctctccataagttgtcttagtaagaaaatggcctccatagttgatctcccgggcatgaaaccaaactgattttgggtcacgctcgtcagctttcgcaggcggtgttcaatgactctctcccatagcttcattgtatggctcatgagtttaattccacggtaattagtacaactttgaacatctcctttgttcttgaagattggtactaatgtactccgccgccactcgtcgggcattctgtttgtccgaaagatggtgttgaaaagcttagtcagccatactatcgctatgtctccaaggcatctccatacctcgatagggataccatcagggcccatcgcctttcctaccttcatcctttttagcgcctccttaacttcatattcttgtatccttcgcacaaaacccctgttgttgtcatcgaatggttcgtccaattctattgtagaactctcattccctccattgaacaatttgttgaagtactccttccatctattcttgatctcttcattcttcactaatagttggtttgcttcatccttgatgcatttgacttggttgacatcccttgtcttcctttcacgaatcttggccatcctatagatatccttttctccctgctttgtgtccaaccgttgataaaggttgtcaaaggcttgaccccgggctctactaaccgctcgctttgcagacttcttcgctatcctatacttctctatgttttctgcacacttgtcatgatgtaagcgtttgtagcaatctttcttctcctttttttatcgaatacgcaggagggctgcgtatcattaaattaaagtagagggaaaaagggcctgtggcccgggacaaacagaacacacaacacaaacacacactctaaacacaaacacacacttacccttacaaagcacacaccacacagacacaaacgaccccaacactcccgtcttttagtaggctataaggctttcctttctctatccagggtcaaaaagagagcgcaagttcttggctccagcagaaacccacaatctcatctcatctttaaatccatcctctaaggtattaaggcagggtcgagctccttcaaaaacacacctgtttcgctgcttccaaatactccaagccccaaggattatcatactattaaaccccttttttttgctctttggaatcttggttgaagcctttctccaccattcagcaaaaactgaatctcttctcttaggactcacagaagagagaccaatgggggttaaaatcttatgccaaaactgtcttgtgaagacgcaattagatagaatatgctgcacagtttcgtcttcctggtcacatagaacacaaaattcaggatgctgaagtcccctttttttaagtctgtccgctgtccaacatttgttatttatggccagccaaacaaaggtcttacacttaggcgctgcccagctcttccaaattcttttccagggctcaaaggattctgctccaatgaatagagctttataggcagatttggaggtgtacagaccatcgttgctaaatttccacacatgctgatcatttgaattttgaagttgaaaagattcaattacctcccataattgtagatattgctcaatctcagctagggagagattcctctggatatcttgaacccataaatgagaggtgagggcctgctgcacagtccttacttttttaaacttcatcggaactgcagcagcaataaggggagctatatctacaatagaatacccatgaatccacttatctttccaaaataaagttgaaataccattaccaatggtggtagtcactgctatctgaaataaagcccgggcctgggaagatattttaagatccaggccactccaaggcttcgaaggagaagttttttgtagccaaagccatcgcaattgtagggcccagttcatcttttggagattaggaattccaaggccccctaaatcaagaggccgagagattttatcccaagctacaaggcaattacctcctctagcctcctttcttcctttccacaagaagttccgttgaattttatcaatggctttgataacccatttaggagcattaagagcaataaataagtaaactgggatggcagagaggacagatttgataagagtgattcttcccgcaagatttaaaagctcagccttccatcctggaagcttggcagcaattttatctatccagtgagcgagatccccagcacaaagttttttgcagcttagagggagaccaagataggttgtgggaaaattttttgaggcacatcccaaggtctgaacagccagcgcagtcctctcagtattgcactggattgggtaggagaaacttttttgcaagttagtatgaagacctgaggcaacaccaaaacacctcaaaatttctctgactaccacaaagtccccagaaactggttttacaaacacagcaacatcatctgcaaacattgaaaccctttggctaatgtttctgccagcaagggggtgtaataaaccacactcatctgccctgataaataggctattaagaacatccatgactaggatgaataaaaggggagataaaggatcaccttgtctcaacccacgcttgagatttataggctgtccaggcactccattgacaagaacttgagtggaagatgtccatagcaggttcaaaatcagattgcaccaaccctgcccaaagcctaagtgttgaagaatttccagcagaaatgcccaatgcactgagtcaaaggcctttttaatgtccagcttcaagaaaattgcagggatttttttctggtgcaacatcttggcagtttgactaaccataataaagttatcatgaatacatcttccccgaatgacaggctacaaaaaacgaggtctcaatcatcctgagagatgccccctttgtgaccaagagcctgagactatagatcatctacttgtagggtgtgtctttgagaggaacttctggtttatgctgcttggacaggtcaacctccaaagttttactcctcaggttggagaagaaaatgtcatgcagtggtggaaaagctgcagtgaccagctgcaacagattgctagaaaaggtttcaactctttaattatcctggggctttggacaatttggaaccacagaaatagatgcgtatttgatggtctttctcctaacttggaaacagccatcagaagagcggatgaagaaagagaaatgtgggagctggctggtgccaagcccaagagtttggccctccttactgcctcccggggattggctcgtagtgttttttagtttgtttagatggatcttcgcaggtttgagttttagacctccgtaaaggagtctttgtacctggtctgttttttcagaccttcttttccttcttcttaatataacggggcacagttttcctacgcttttcgagaaaaaagtcaaagcatcactaccatatttgagcagtttatatgaaatatcgtagttgtcaatgtatgtgcttcctctgtggttcaacaatatgtcttgagacttgagagataagtccttactctagtaatgtgtgatggcattactatttattctcataacataaatattagaccagatttctaaacatgatgtcgaagggctgaattttttatataatatttgtcaaccttctgtgcgcactcaacttatattgtataaatgggcagtaagttgctttgggttccttaactttctgtgcgcgctcaactcattagttactgtaacagcataaatattttgggataattgccaaacacatacctgttgcagtgtctaacttgaagatatgttcctgtgtgcacagttgcgcacacatttccgtgatcacgtttttggtagaagtcatatatttgttttacctggaagacaatttgaagctaccatatgttatagtttccaatatattcataattgcagagagatcagattagtaaatcttttggaaactctggttgcaattctcatcctttaataatttgttcgtagataaacatttaaacaaaaccatgtgccttaaaaataagcacaacaatgttatctgaattttttttgttgacagcaattgaatctaacacttgaactttcaggagatgttccccgagtatgtggtcagttggctgtctccagagcttttggagacaggaatctaaaatcactattgagatcagagcctgatataaaaatcgaagacatagatcacactgccgagctacttgttcttgcgagtgacggtctttggaaggtgtggcacgttatttcaaaatttgtcgaaatggccaggatgtagttgaccggaagcatatccatggctgcactcttaatttctttccttttattgaccctaccaggtgatgaacaatcaagaggttgtcgatttggccaaaaggtacaaggatccctatgctgctgccaagcaattaaccgtcgaagcacaaaaaagagatagtaaggatgatatatcatgcatcgttgttcggttcaaggcgtaagtcggtctcgaaggattttcatcgagagcaaaaaaacaagtgaattaggctgcctgacgatggtagtgataatctgatggttgaataatgactggggtgttggatgtaaatgatttgtctgctccaatgtaaagttcatatataagtatgctaggattatttggtttggcgatttcaaaggtacaggtgcgagggcccgagagctactaaatagctaccatctgtaaataatggttatattggatgttgaatttgtaagagtagactgagcaaaagacatctggatagttcctaaaagaacaaggtactctttatgttcagaaagttctacaggtgtgtatgtgcttcagttagattttaaataaatcctagcaaggtggaagaggaatacatagtagcatgttacagcggtaggatggttagattaaaggaacctttgttgaccatagatccttaatgtcatgacccctatatgatttgcgaacctatattagtgagacaaaacttaatttatacttgtacacatatacgctcatggatacagatatgtactcatacacatatcctcgagtatccgctattcgacggatactcactatccgccccactacaatttcaacattcaacatcaaaacaatatttttattataattcaacaattttatcattctaacagcatcaaacaacaatttcagcaacatatcatggatagaaactggaaaatgaaaatttaggatagtgtattgaatccggatggcccacttgtggggatacatattgtcggcgtttcgagacaggggggtccctaagccgacgagtgagtgtgctgcgtgccccagcccagatggatcgagcgcgtgggcgagcgcgaaggggggagaggcgaggtggccggagtcgagcgtgagagaggtggaagtcccgcggccttcgtgttcgtcccgcgcccaggtcaggtgcgcttgcagtaggggggttacaagcgtccacgcgggtgagggaagcgagcggccccaagagagcgcatgtcccgtcctcggtcccgcgcggccaaccttctctaagaaggccctggtcctcccttttatagtcgtaaagagaggatccaggtgtacaatggggggtgtagcagagtgctacgtgtctagcggagggagagctagcgccctaggtacatgccaatgtggcagccggagagatctgggcaccctgctggcgtgatgtcgtggctgtcggaggtgcggcggagcctggcggagggacagctgttggagcggtcgagtccctgctgacgtcgtcctgcttccgtaagagagctgggggccgccgtcgtcatagagcttgtggagcgccatcattgcccctccggcggagctggccggatggga

SEQ ID NO: 486 - protein, 284 aa, Zea mays
MARLCCFGAGCSDFTGQGSIASGKGKGCQGQVKICYGYNLVRGMTNHPMEDYHFAELVDVKGNELGLFAIYDGHLGDTVPMYLQKNLFTNILNEEEFWTHTDRAIIKAYEKTDQAILSHTPDLGQGGSTAVTAILVNGRKLWVANVGDSRAVLLKGGEPIQMSIDHDPNVERSVIENRGGFVSNMPGDVPRVCGQLAVSRAFGDRNLKSLLRSEPDIKIEDIDHTAELLVLASDGLWKVMNNQEVVDLAKRYKDPYAAAKQLTVEAQKRDSKDDISCIVVRFKA

SEQ ID NO: 487 - DNA, 10076 bp, Zea mays
tttctttgttgacactccagtgtcattatttttaaaattattttctatcctaaaaacaactagaaactagtgcagtcgttatttttttctctatcagtctttggcttttgtagaaataagtaagacccaagtaaagttaccattctattctctaatctatcaccaatataagaaacatacaaaatatttacattgatttttttgttattcaatacattccaattaaaatcctgatttgattttctccataaacatttttagcctaaatgacacaaattcaaaattttgggacacattcttatgtttcacacaagggctatcaatattattacatgctaccatgtcacgaaaatatgtttctccttttatattattgcatatcgatattaaactatttcattcttctttgttcacagcatctaatatttttttgtactctgtccggctaacaaacttgattttttaattttattaaaagtcaaactatcttagattcgaccgatctattgaaatgtttagtattatttatggcactaaataggtataccacgaaaatatgttgcgtgatcaatctagtgtacttatttaatactctatatgtcctaaattaaaatttattttaccttttaatagatttatgcaataattaatgtatgtgttccataattgtctaaatttatcatcatctgtttaaatatggatataaaaataaagagttacaacgactaatattttagaactgaggggcagtatacaattattattctaatatataaatttgtttaaactttagattgattgagttttagaaaaaaactaaaatgtctaggttattaggatagattaagtagttatttaattctcttattaaggtcaccgttttaggcagtgcataaatgcacaactgacttatttatatttatagtttttaaaaaaagagtggagtggtactgaaagcacatatccatttatgacaagatcctaaaagacgacacacccggtaaaacaactgcggcaaaactcaccaagcccccaaactgttaacaggtgataaagcttttctctctcttggccggccagtgacatcagacatcaccaactcgtcgacggtagagagagcaagctcttcggcgatttgagaagaatcgaggagcgagcgagcgagcgagcgagagaggaggaggaggagctggggcttgagcctgcgcccgggggccccgggtcacggaatcctaccattaccaaccctagccttcgttgatcgccgtctcaggtcatggcagggccggcgccggatcgggccgccctgactgtggggccgggcatggacatgccaatcatgcacgacagcgaccggtacgagctcgtgcgcgacatcggctccggcaacttcggcgttgcccgcctcatgcgcgaccgccgcaccagcgaactcgtcgccgtcaagtacatcgagcgcggcgagaaggtatcgctctgatcccgttctccctcccctgtggattcgattcggcgctagctgtagttaattaataacccatcgattccacctcacggagtttgcgttccgagggggctattcgatttgggatgtgaatcctttgggtcctgccgcggaccgtatcttcagcccaaggatgacatttatgtgcatttaggttatgtttttgcttgagtgaatatcaactgtggcctgttgctgtttgctccgtctgatacgctggatatgcttactatgctcgaattatagtttgttcctgtggaattttgttgggcgtgttgtatttggggctaagcatttgccaccacaatcattaaacaaacaaacttatgctaatttaatccagtctgcactgaatcggaataataattttatcaccttgtttgctcaagcgaacatcataattttgatatgccacaggatgctggcaacggtggttgtgacttgtgagcttggagttaccagttagcagcatcaaataaacaataccagctagcattcaaacaaagatctatttatttttgtttttcttgaaaataatatttcgcacctgtgacctgcctggggatcgaacgcaggtcacaagcgccacactcacatgctgccaccactacgatctcacaggttatctggtctcaatatttctagttgggtctattttatgcagatttagtaaaaatatgtcctgtaggattagaaatattgacttagttaaccctggaacatgtttccctgttttgcgttgaataaaaagggaagaaagtttttttttattttgaagtaccccctaggcttctaatgtcataccctttttttatccaaacatagcagcaaataatgattactaataacacaggtagctgactttattgggaatatgcttctattccagcatactgcatctacttttaattgagctgagtaatggtgtatgatttggcccaagaaatatgtaatctatctaattggtaaggggggattgcatggttgctccttctcgaggatgcaaccccgttttacccctgtttttctgaagtttgcacgtatactcttttttaaaatgaatagactattcacccctattccgttattagcatttaacggtgttagctcagcctgcaaaaatacgtttatacccttgcaccattgttccttcttttatcaactatttgcaaatttgcctccactttaatattaactttggaatataatgatggcttaaatctgaccataaattttggaaatcaatacttcaactttaaatcaaaaaaatgctgaaaataaattgaatttgacactacatcttgacaaaattgacaacattttaattgtaattttgaaatatttcaattataatatattttcaagattttaatttaaatattgttattctgtcaacatttaatgttaacttcaatttattttcatcaatttagaaatgttattaaattcaaatttgaaatattgattttcaaagtttattgttagatttatatcacaattatattctaaactttcatatcaaagtggcggcgaatttgcaaacaattgataaaaggagggacaatggtgcaagggtattaacgttttttttgtgggctgagttaacactgttaagtgatgataacggaatagggaaaactacctatctctttcaaaaaagggcatacatgtaaactttaaaaaacaggggtaaaacgaagttgtatctccgagtaggggcaaccattcaacgacctcaattggtaatgatgctccataactctatgccacaactaacttctactacttgatgcatgggagtgtatgtcttataaaaagaaattgaaacagtatgtgtctaggacccaacaaaatattgcatgaatttcacaagaccacattatactgggaaaagtttttgcaacttgcaagcctttcctgttcctttaactaatattgaggtagttgcatacttgttatactgtactgtacaagagccgacacgttttgattgcatagcgaggtgggggaaagtggaatccttttgatacactatgaagtagaatacttgtactagtaattccatctcattcagctccatccagccaagcaattgcattgatgtgtaagctctttactgaatgaacatgttttatccatgtgtgtgtatttctaattggaggtacctgtgcattgttttgtaataccattgctttactgttgtggccatatggtctagtagtttttgatagaacaaataatcaataatatcttgaacttctgaaaccaaggatagttgagcagattcttgttacattcctttgattttggcttcaacccctgagagaccaacatcaattcatactaaaagcccaatattgtttatgatctctatcaatagcaagacattgggtctagtttatggaatttcctctctcattcatttggtgatttgatttaaataattccaatgtccatagtgccttaaatctgttttttgtgcattttcttcttctatcataagtgctaggttgtcattttttactgcactcagttgttttatcttggttttctttaatatgtattccgttgtcatgtgcagatagatgagaatgtccagcgtgagataattaaccatagatcattgaagcaccctaacattattaggtttaaagaggtgagttgggattgtgatgctgtttctccccagaattccattgttaaacatttttttattcttctttgtatgtctaggttattttaacaccgacccatcttgctattgtcatggaatatgcctctggcggtgagctttttgagaggatatgtaagaacgtgcgattcagtgaagatgaggtttgtgcttgccactttgttcatctttcttcttgacacatctctttcttgatcctaccaaatgcacatatatatctttccaggctcgctacttcttccagcagcttatttcaggagtaagctactgccattcaatggtattagttattatatagtggcatatcttccatcctattgttactgtttactcataccatgcattgagttgagctgcctttttattcttattttcaagcaagtatgccaccgtgatttgaagttggagaacacacttctagatgggagtgacgctcctcgcttgaagatttgcgatttcggttattccaaggttcttacccatgtcaacttcatcttgttctagcttatatttatgtgaatatgtcaggccaccccgtatgtatcagatatgttgctgagatggatatgcgtgggacacaacatggatacatctccatggagtttcggggaaaaacataaatgagagcaattctgatacatgagtgaagatgtattgaggggctttgtggatacggttcagtccagtaggcctactataacccttgactcacatgcgctgatgtgcaccggcagtcagtgacacgacatgcctgccgctgccgctgcccacctgacttcctgctcgcccagctgcctgcctgcccccaccatgagaaatccagcgttgtttgcacacttgagcaggctgtggctgtggacgcacaccacccacaagatgcacgccggaaattggtgagcacttcacggcactgcaacgagcttcaccacacaccggtgataaatcagcaccaagctggtgatgagttagcagtgattccttccatgtttcgtcttctctcctgtagcctcttcctgccccattcttcgtatcaaatttgaactagaactgaaaggggaagggattggatcagtgatttactcatctcctccaagcctgaagcctcaccctcaagtaaaaagtgatgtacttagttgagtcctccctgtttaactagttttactactgcactaagtgcttatatgttctcactaggttagtacccgtgcgttgcaacgggaacatataataccatgataacttatatacaaaatgtgtcttatattgttataagaaaatatttcataatccatttgtgatcctagcaatacataaattttgttattttaatttagttgtttcactactacattgcaaccatcagtatcatgcagacttcgatatatgtcatgatttgcatggtctcattattggagagcacgtgccacacctgccggtagaagttccgtcgtacatcgttagtcatcaggcacgcaccaccatacacgcttgcttaaacaaaaaatgcaagtgtgtgtttgcgaagagaattaaaggcaggccggcacaaaaggtaccccgacgatggcgagtggtcattgttgtcggtccacctctgctcacctccggtgtcgagatgacgccacaatccttgatataatagtcgtcgaacgcgcgtgatatggtgagtaccgatcactcttggctgggctgccaaatgaagtgcaccccgggctcatcagcgaggtagtacacctggtcgttgcaccaccggatgtgctactcctctacatacatcttgttcgaggacactcacacaacaacaacaatggtcatcattccagcgcacaagaattcatggtcggtcagtagcgacttacatagcaggttaggcttcaggtggatgatgagctagacagcgtgatggcgtcgtcgtaggttgcgatgcccagaacaacccgagagtcgtcgacattggcgacgaccatgaggtccccatgtttgacgatggacagcgcggtgcagccgctctggaccacgtccaagcggcggctgcgccggagcttgccgtacacagcggcgcatgggccatgtaggactgcttccagagttcgaactggcagtcgccaagtttcttctcgtcgtcggtgagcgacgccaacgcgagcgcctcgtgctagtggtgtttgttcggggtttccaagtaagaaacatggattcatctttggcattggtttatgaaaatgatttataagttagatccatggaaaaatattatggagaataaatgttacacatgcaaaaaaagtatttaagttgaaaacattattcaaacaaaagaaattgcatgcaaggctcttctttaaatactactccctcaatccaaaaatataatttaataatctcagtgatacttatctactactacacattgtgcaagggtagcaggtgggcttcgggggagatgtattatatgtttttactataatagatgtagacataaacacacatgtggtgtagtggtagctacaaacacatttatttgagaggtcgcgggttcgaatccccttggagcctgtttttttaatttaattttagctaggcgtgggatgcacgtgggaatgggaatagactttgtgggagggggaatgagaaagacacgtgatagccgggaatggaaatgtgaatgggctttgcagggagggggaatgagaaagacaggcagctgggaatgagaatgggctttgcagtgaggacggaatggcaatggcagaacacggaatggggcagcctaccccttaccgtcttaataggtagtagagattttgattctgcaagtttgactttgaggtttggatggagttgctcggcaagcttggctattggagtgttggctaaatggaaatatgaaataatcagcagaacacaattgcaagaatgcaaggaaatttcaagttcctgctagtgtgttacgggcttttgaattttaatatgccttattatttatttattaaaaatactaaaaacatatctgcatattgttctttaagaaaaatggacatttgtgtatctgcctgatactgatatgctgaattttaatatgccttattatttatttattaaaaatactaaaaacatatctgcatattgttctttaagaaaaatggatatttgtgtatctgcccgatactgatatgcatatctatacctgtgctgcatagtgttcgagtacatgtttctgtgggtttgtggctagcactcattgatgttctattgttctatggcttaatgtttacacgatggtagtagaataatgaatatgatcatagcgttgtcagttttcttttaactaacaataccatgcatttttcattctctgcagtcatctgttcttcattcccagccgaagtccactgttggaacacctgcttatattgcacctgaagttttgttgaaaaaagaatatgatggcaaggtacttgtgctatcactttttttatcttgagaaatgtgtcttgagagttgtgcatacctctgcatcagtgcactgttgttccatatacatgtgccacatgttcttagtggtcagaaaacttccacttatgatttctcttttagtgttcactgtctggttacctcctatatgaggaaagcttctcctcaccgatggatttgtttacgacaaaacagattgctgacgtttggtcatgtggtgtaaccctctatgtaatggttgttggcgcatatccttttgaagatccagaagagcctaagaacttccgcaagacaattcaggttatctttttttttcagcatgggtacaagttgaatgcacaagagtgcacacgtacttctgtcagttatagcacatatgtgtgtgtcctagcacgcacccacctaaactctagatcggctactttctgagtctgcatgtttaacttaatgcattatcctgttttagctaacaactaaactaatggtagtgtcatcttgttatagcgtatcttgaatgttcagtacgcaattccagacaacgtgaacatatctccagagtgcaggcatctaatttcgaggatttttgttggcgatcctgctacggtaagtccttgtatgttgtagtcttgctttgaccttgatatagaaggttcagaagatatgctgttttgagttttgtcatatttatctgattttgttgtattcatttgtcataaattatgcagcgaataacaatccctgaaatccggaatcatagttggttcctgaagaaccttcctgctgatctgatggatgatgatagcatgagcaaccaatatgaggagcctgaccagccaatgcagaccatggatcagatcatgcagattttaacagaggccaccataccacctgcctgttctcgcagtataaatgtcctagctgatggactggacatggatgacgacatggatgatcttgattccgactcagatcttgatgttgacagcagcggtgagattgtgtacgcaatgtgagtaacatctcagcagccatctcagcagtcaaccaaggaaccaatcaggcatgggatgccctgttgtatactctggcaaagggcatgcttccttttgtgaaaaacatccatgtagttttctcaaggaatcgcaatgtgttctgtggaacacatatgttgtagtcaaactcgggttactcagcttgtaaaactagcctcctcttgcttcctggttactgggctttggatactctcaggcttcgacttgtgtgttgctgttaaatatgtataagaaacttctactcaggttgatctgtgaatctggattccggtagtggttttgctcagtgttgggtgtattcccgatttctgcatttcaaactctgatgattaggtcttgtatttaggcggtttctggatttcaaaatttgtgtttttttgtgcaatttacattttcggggtgttaggcactttcatgtttaatttaaggggtgtttggttcccacggagttaatgggctctaaattttacactataaaatctatcgtgttcattttgaactaaagttaattaagggttctaaaaatttgtgaataaatatttgaatcgtgatctattaccacccttattcccaccttgttattcccaccttggcagtgagaaggttgtcatgtctagaatagggatggtagtggggagccgatttctgtgggaaattcctccattagagcttgtttgatatccacaaaatagaggaggatcagagagctaaaatcctctctttatttaattttaaatgagaagtggattttagcctctctaacccctccggtttttggactttcaaactagcccttagaagacggggatggggccaatttaacccctccggtttttggacttctaaactatcttccgcactccgaattatttctaacactaaccccgagcatagtgcatgttcaaagtttgtaaatttcaggtttcgcatattcaccccctctaagcgactttcaataagcaaatgcaacaagaatacgatggttgatgatcatgagaaggaagagaagactatatggaattcccacaataaggtgaagagtaagactattgcatcccttgagaagatgaaggaaaaacttttcaataccaacaataagaagaaaatgctgaacaaaacacaaagcgaaggaggagaataaggaaatgctgaacaaaacacacaaagagaagtaatgggctgtcaacagcaaggagagaaagataacgagtggccacaaaaggttaaacagtggggaagcgtccactgcattctttgggaataaaaagaaagcaaaaaaggccgagtaagacctacaaccaagagctgcaaaggaatgaagatgaagaggaggagatgtgagattatcccagta

SEQ ID NO: 488 - protein, 366 aa, Zea mays
MAGPAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISPECRHLISRIFVGDPATRITIPEIRNHSWFLKNLPADLMDDDSMSNQYEEPDQPMQTMDQIMQILTEATIPPACSRSINVLADGLDMDDDMDDLDSDSDLDVDSSGEIVYAM

SEQ ID NO: 489 - DNA, 3854 bp, Zea mays
tgagtccgtagtgtagggattacaaattaatggaatctgcagacgttgtggccgtaatagtaagaactaccattagttgcagtaaatatggaggatattaagcgggtgagtaccatagaaatgtgtaaccctaaaaggcacaccagatccgtggagttctttgaactgcggattaatcgggtcttctaggatgaaatcacttacggtccaaaggattagtgagttggtgtacaaattacttgttcaaatatgcgcgcaagaagaacataaacaataggagtcgaagggcgtacctgaagatccggagatttgggcggagagaagaggaatcgaagcgttgattcccggagccgatgaaggcgtcgatgctcggagcggcaaacgaagctagcgctcgcgaggaacctcgacggagccggatttgcggccgcttcgtcttcgctcgcgactggaggtggttggtgaccaactccacttcgtcttccacagccccgacggggaccggcgcggtcgcaacctttccgcgcacgaatcgccgacgcctcgtccgaaatcgcagacgcctccaacgggacagaagacgaccgcgaaggttccggtcggtggcgcgggcggagtcttccgcgtgaagccgtggaggaggagtgcacagtcgcgcgctgcatctggggtgagagagaagagggtcgcggcggagggggcgcgtagcaacgagcgttgcggcttcaaggggtgaacagtatcccctataccgtctacagtgataggggaggggaggggaaggggggagcgctgcagtcagtctaaggggcccttccccgctcccgccgccaatagggggctcccacctcaccccctcctcgcggctccaccgcacggttcaactgagccgaccccacccgtcaggtccgcgtgcccgcctcccgttggtccgccgagcaccacatcacaccgctacatacaaataaataagcgagacaccggcgcccaacgacttcccaaatcccgtgtgctggcgtgctcgagcccacatcccaaccatatacgagacgagccgacgttcccccgggcccccaaggaaaaccatgtgctgtgcccgccaggtgccactaaatcggtagcgcatgctagcactgagacggagctcccagtaacggcaacaacaagcagcagcagccagacagccagtagtaacacagtaaccggcagaggccatggcgagatcaaggcaggaaggggaggccggaggagaggagcggaagctggtcctgggcaagtacgagctgggccgcctgctggggcagggcaccttcgccaaggtgtactacgcgcgggacctgagcgccgccgccggcacgggcagcaccagcgtggccatcaaggtgatcgacaaggcgcggctgcggcgcatggaggggatggtggagcagctgcgccgggagatctccatcatgcggatggtgcgccaccccaacgtggtgggcatccgggaggtgctcgccagccgctcccgcgtcttcgtggtcatggagtacgcgcgcggcggggagctcttcgccaaggtggcccggggccgcctcaccgaggaccacgcgcggcgctacttccagcagctcgtggccgccgtcggcttctgccaccgccgcggcgtcgcgcaccgggacctcaagcccgagaacctgctgctcgacggggacggccggctcaaggtcaccgacttcgggctcgccgcgctgcccgagcagctgcgccacgacggcctgctccacacgcagtgcggcacccccgcgtacgtcgcgcccgaggtgctcaggaagcgcggctacgacggcgcccgcgccgacctctggtcctgcggcgtcgtgctctacgtcctgctctgcggcttcctcccgttccagcacgacaactgcgccaagatgtaccagaggatcttcaaggccgagtaccaggtgccgccctgggtgtccggcgacgcgcgccgcctcatcgcgcgcctgctcgtcgtcgaccccgccaagcgcgcctctatcccggaggtcatgtgcacgccgtggttcaggaagggcttcgtgccgcccgtcctttcagtttcacccccgatgacgcccaagaaacggctggacggagatgacgacggcggcggtgcgctcttcgacagcagcagcaactctggcgccacctctcctcggtcgtgcaacgcgttccagctcatctcctccatgtcctccgggctcgacctgtcggggctgttcgagaacgaacagaaggccgcgaccgtgttcacggcccgcgcgccggcggccaccgtggtggagaagctcgagtccgcagcgcgcgccctgggattcgagaccaccagggggaagggctggaaggtgaggatggaggctaaggccgggggcacaaacggacggctcgctgtcaccgccgaggtgctcgaggtggccgtggacgtggccgtcgtcgagttcgcgcacgacgccggggacgcgctggacttcaacaagttctgcgctgtggacgtccgtccggggctcgcggaaatcgtctgggcgtggcagggcgacagcccggccgccgtcgttgggaccgcgtgaacctacggccgcccgttcgtcctggcgtccacgcctgttggagccagccttacacggctgcatcggcatcatgtaaagtttccgttgttgcttcgagacagccatggctagttcgttatgagtcgtatgttgtacaggaagagaacaagtgcaaaactgaagagaggtttctgtcgacacgagagccgaatcgagccgggagtgttcgatcggcttgcaaagttttgtagatcatataatcgctattttgtggagatgcgcacatacacaattttgttttggtcgccatatgatttttgcccatctgaatgattgtgccattcgcaattaaatcaaattattactatgtggtttccagagcagctaaggggactgttaataagaatatgcagattcttttggtgtacgttttttttggtgggtggggttcttacttttaagactagtttgagagccacaaaacctaagtagattagagatgctataatcctcttcttaatcagctagaatctcttttttatttacatttgaataaggagaggattctagcttctttaatcctctctggttttgtggctcccaaacgagccttagtatctaggtacgccgatatacggtaagaaattaggaacgagatcctctgacgtgaggagagggcactgccgcgtggcccccgcgtgcgacagggcccgcgtgcagtgaccctactgcccctgcagtacgtcagaggaacctcctccaagaaattacgggacgatgattggatgattatgctggcatccagcggaaattaggagggtgctttcaagccttgttcactcatttccactctatttgaattggatgagataaaaaaaattaagacctcgttcggttacaaggaataaaatctcataatgaatttaattttaatcttaattgtgtgaatccatacctcacacccaatcccttcatagattataatataaacttgtgcaaatatcttcatagatttgttccatacctaatgagccatggatagaattatagcatcatgtcttccatagtttaaaaaattcttaaaacattgggttataatctatgatgggtctaaccaaataaaaaaattaagtaggcttgaattattttggggcatgaattgtgacaaggatttaattccaatccatgataatttaaagttggattggtataaataaacaaggccaaagaaggattgtgacccgttaggattttaagtcactcaatctcgttcaa

SEQ ID NO: 490 - protein, 462 aa, Zea mays
MARSRRREGEAGGEERKLVLGKYELGRLLGQGTFAKVYYARDLSAAAGTGSTSVAIKVIDKARLRRMEGMMEQLRREISIMRMVRHPNVVGIREVLASRSRVFVVMEYARGGELFAKVARGRLTEDHARRYFQQLVAAVGFCHRRGVAHRDLKPENLLLDEDGRLKVTDFGLAALPEQLRHDGLLHTQCGTPAYVAPEVLRKRGYDGARADLWSCGVVLYVLLCGFLPFQHDNCAKMYQRIFKAEYQVPPWVSGDARRLIARLLVVDPAKRASIPEVMCTPWFRKGFVPPVLSVSPPMTPKKRLDGDDGGGGALFDSSSNSGATSPRSCNAFQLISSMSSGLDLSGLFENEHKAATVFTARAPAATVVEKLESAARALGFETTRGKGWKVRMEAKAGGTNGRLAVTAEVLEVAVDVAVVEFAHDAGDALDFNKFCAVDVRPGLAEIVWAWQGDSPAAVVGTA

SEQ ID NO: 491 - DNA, 5590 bp, Zea mays
ggcaacgttagggacggggcatggggggtcgacaccagtgaggtggctcagtggcagggcatgctcggcgcgggcgagtctccacaagcgcgtggtctagcagggcagtctcaacaagcgtggggtgcttgtgcggcggcacatatgtggtgggtagtggtgcggttcggcgttgactagagcgcgaagacacaaaaaaacacgtgaggaagaaagaacacatgaggaagaaagataagtagttgtcctatatacctaattttcgacggtcatacgccaaaattaaacctttaattttagatggcttgcagaaagtcaccgaaagtaaaattttttttcggtggccacgtgtcaattgccgaaaattagattatgtaaacggttttaaaggtgagggggtgaagtaaaccactctctaaaggtcagaagtcatgtaaacttattctataaaaatggatccagcttcttttcaacttatacttttctcgtcctttagctaaaataagatataatatttttttcttatcgatttaatatctgatatgttaaccatatgttccatattaaatttattttttattggtaacaaatatgattgtgttgttcctataaaaagggtttagctccttttgaactcatacattttttggtcttttggttaagataacatataatatttgtttttatcaacttgatatctgatatatgaactatatgttcatttaaatattaaatttattttttttggaaaataaatatgattgtgtgccgtcgcaacacatatgattatactagtaatagtctatggcacacttttacatgtaaatagataatgtatcatatatggatatattataaacgccatgcgaatacggtggcggttaaagaaactttcccgtggaatccgacatggtccggcaatgattgcaataatggaaatggaaaaggacgccggcgcagccgcgcagtgcagcatccactcacagcgggagaggggaccggtcatcacggttgatcgtggcaaatatcaaaatctctcccattccactgcccctaccacagttccactggccttcgcttcgccacggttctcgcctcctcgcattctaaacatcgccatgattcggtggttctgaatgcatctcctgtaaccaccgggcccggagcttctcccaagcccgcgtcgccgtcgagggctgttaacctggcaacactctcaccaaccaacaaacaaacgcgcggggtcgctgtaatggccgccgccgccgccgctgtgaatggtaagcgatcggtccgttgcacgctcatttaacgtttgaattggtttgagataactgtcgagcacatggcgtgcaggttttgtatgagaattgagtcctggagttgactgcggggactgatggtttctggctgtgttgttgcagggagcctagaccgcctagacgtgcatgagaggaaggcgcagaagagctactgggaggagcactctggggagctcaacctcgaggccattatgctcgactcccgtgccgccgaactcgacaaggaggagcgccccgaggtgatttatcccgcgacgatatttttcactcggctttttttagttttagttcgtatgtttgtgattcatcagcttgaacatgactacatgaggacgtgctaatgctcgtgcgatcgtagccttgtacgcttcaaattttgatgtaccggtgcttcttttttgtaggttctgtctttacttccttcatatgaagggaaatctatactggagctgggagctggaataggtcgctttactggtgaactggctaaaacatctgggcatgtttttgcagtggatttcgttgaaagtgtgattaaaaaggtactgaaatttacactcccccgtgatgtaaatattttcagggcttcgtagctgaaatttgatcgttttgtagaatggaagtataaatgatcactatggcaacacgtcctttatgtgtgctgatgttacatccacggacctgatgattgaagcaaactccattgatctgatattttcaaactggttgctgatgtatctttcagatgaggaggtaaggatcaaaccgtacgttagaatcataaactggttcaaggtctatcgctaaagaaaaaacttaactgcaacttttcgtgtggataaggttacatttatcatttgacctgaattgggatatgtttgtcccttccgatttttctaactgtctctcttactgtagattgacaagttggtagaaagaatggtaaaatggttgaaggtcggtggttatatcttctttagggaatcttgcttccatcaaactggagatacagaaaggaaatttaacccaacacactatcgagaaccaaggttttataccaaggtgagaatgcaccccccccccccccccctatgatttcagtcaattcaaatctttctgttcttacccactccactctttagttttcttagattgagtaccagctttctatgaatttgctgataatgtcttttcccatctaggtatttaaagaatgccaaacctttaatcaggatggcacttccttcaaactttctttgattacattcaaatgcattggagcttatgtaaacatcaagaaagatcaaaaccaggtacttctctgtcctcacacctacacatagacttgcgctttcattcctatgaaataagtgattaacatgacttcattgtttccagatatgttggctatggaaaaaagtaaactcatcagaagatgggggatttcaaagttttttggacaatgtgcagtacaaagccactggaatactacgctatgaacgtatctttggagatggctacgtgagtactggtggagctggtgagaggacacatccctttttgtcatttttttgtgatatcgtatgtgcagtgccattaaatgttattattcatcactatgcaccagagactacaaaagaatttgtggagaaactgaatcttaagcctgggcagaaggtgcttgatgttggatgtggaattgggggaggtgacttttatatggctgagaagtatggtacacatgttgttggtattgacctttccattaacatgattatgtttgcccttgagcgttccattggatgtaagtgcttagttgagtttgaagttgctgattgcaccacaaagacatacccagaccacatgtttgatgtcatctacagtcgtgacactatccttcatatacaagtatgctttatacatataatgcatgtagtccttttcttccaagatgatagagctacatcttgatcatatagaatcatggaaactatcttcagttatagatgtacttattagaaacttgtttatgtcatacctttagttgactgtttaactaacatgccttttctggttttgactctgcaggataaaccctccttgtttaaaagtttcttcaaatggctgaaacccgggggaaaggttctaatcagtgattactgcaagagtcctggaaaaccatcagaagagtttgcaacatacattaagcagaggggttatgatctccatgatgtggaggcttatggacaggtggtttttagcttttacctgatcttattttgtgtgcgtggttaatgtttaatacaagtgatttgatctaaaagtacaattccgtttgatgagcaataaacatctgtttcccaaattatctagatgctcaagaatgctggtttcagtcatgtcattgctgaagaccgaactgaccaggtctacccatctaagcatatgcaatctgcatgttcttattcctgtctaatgtctagtaagatgcttggataaacagttttagtgacacactgtgttttgtctttcagttcctcagtgttttacagaaggagctagacaaatttgagaagaacaaagatgatttcctgtctgagtttgcccaggtgattcgataaagcccctaagaagttcaacaataaaaacgcgtagcaaaaataaaaatagcaaaagttcagcaatgaactggctggcgctttagaaacctgcattatttctctgctgctctaaaacagctctaactcttatttttatttgttcccaggaggattatgacgatatcgtgaatggatggaaggcaaaactgcagaggagctctgctggtgagcagaggtgggggctgttcgtcgccaccaagtgatgcgcgtgcgtgtggctttattacaaataacatttggagctctgctggtgagcagaggtgggggctgttcgtcgccaccaagtgatgcgcgtgcgtgtggctttattacaaataaatttgaagctctgctggtgagcagaggtgggctgttcgtcgccaccaagtgatgcgcgtgcgtgtggctttattacaaataaatttgcttctgcaattcaccgatgggattcgcttcataacgtgattttacataactgaactcagagagcctatcctattgctttgtgttttgggacaatgagactgatataacttttacggtcctgttaaatatagagtgtgctgtactgatgctcctcatggctgtggctacatggttgacacgtgacatgagatttgttattttcatatttttttagaaaaatattttgcatctcaacttttgaccaatgtgcatcagatgcattgaatctgtgcatcattttataatttttttaaaacttatgtgtacgtgtttcactagaattacgaagcatcgccattgtactgaacacgagatttacactgaatatgtaccgaacatgtatatttgcgtgccatagttcttttcttcatttttgccaaactatcaaacagtagcggaactaggatttttatatagggtgtgtcgcaacaaaaatttcgtgtagaattctatctaatttatatataatttcataataaatttggtaaacaatttgatatatagatataaagtttgacactcaataaataaacatgaaaattgcatacattaaacataaagattacaataatactacttatatggtctgcgcttcctcaacgccataaaagttttaattatatcttcatcattcacttcgaaaataatggtaatgaaaaagagagataatatctccatgcttctttatatcttagtcactacaaaaataatgatagtgaatcaacaatcaataagacaaaaatcaacaccaatatatatagacatacattgcgttagacaaaattcaacaaaaaaaaaatatctagaccggacttggcaaagttcacgttgaacagcaaaggctggaagcggagaccggggagcctggctgcttgggaagtgggaacagccaaggggcacaacagataaatagccagggccgttcctgacttttgagggacccggaacaagattataaacataggctccaacaccataaaaactattttttactattatatatagtccctccgtttcgttttagttgtcgctggatagtacaaaattgaactatccagcgacaactaaaaagaaacagagggagtatcaactaattatacttgatgtaccacagaaagacttgagcagtaaaaaatataagtaagattattaccttaaatatat

SEQ ID NO: 492 - protein, 501 aa, Zea mays
MAAAAAAVNGSLDRLDVHERKAQKSYWEEHSGELNLEAIMLDSRAAELDKEERPEVLSLLPSYEGKSILELGAGIGRFTGELAKTSGHVFAVDFVESVIKKNGSINDHYGNTSFMCADVTSTDLMIEANSIDLIFSNWLLMYLSDEEIDKLVERMVKWLKVGGYIFFRESCFHQTGDTERKFNPTHYREPRFYTKVFKECQTFNQDGTSFKLSLITFKCIGAYVNIKKDQNQICWLWKKVNSSEDGGFQSFLDNVQYKATGILRYERIFGDGYVSTGGAETTKEFVEKLNLKPGQKVLDVGCGIGGGDFYMAEKYGTHVVGIDLSINMIMFALERSIGCKCLVEFEVADCTTKTYPDHMFDVIYSRDTILHIQDKPSLFKSFFKWLKPGGKVLISDYCKSPGKPSEEFATYIKQRGYDLHDVEAYGQMLKNAGFSHVIAEDRTDQFLSVLQKELDKFEKNKDDFLSEFAQEDYDDIVNGWKAKLQRSSAGEQRWGLFVATK

SEQ ID NO: 493 - DNA, 8792 bp, Zea mays
atactgtttttttccgatcgttttcgaattgttcaagaaccgattagaaacggtacgaaaacgatttagctagtttttcgatcgttttcgtatttttcattttcgagtcgtgctaataccgttttctaccgttttatataatatgagatagatctagcacataatttatttaagttatagacttttgttgtgttcaagtgaatgaatacgcgaaaaacaaatgttataattactctaactattatgaatgatgaaaaagagttgtttgtgtatttctaaatcttaaaaattaggcaatacatcactttattatgtttttgataaaactacaaaatagttatctttccgactatagtttattgttttcgatcgtttccgagtaaccgacacttccgatcctgtattgcgaccatttggtttggttttcgttttcgttttcgtcccgaccaaaaaatataaaaacaaaaacaatttagctattttttcgatcgtttttgaccgttttcatccctattcatgggcctatactgctataccccaccatgcaccatggtccagagtcgagagaggcagaggtgcgcttccccgtgagactgtcttcaacggtgaacgcctccctcccccctcccattctgtagcggcaacaggatccccctatacactgcatcggttcccccttcaatgccctcaataccacagcaggcttctctctccctctccgtcaagcgtgacgctaaatcgtcctcccacctcgctgttgtcatcgagtgcactgccatggacgtcatcgtcccgctccataggttgccgcgccaccgagcagagaaccagtagttgagttagctgtagcgcaatgtatattttagtagcatggtgggatttagagatatggtatagaggaaaccattgcagaaggtgaatatatagggggagagagggtgatgatgtggcatggaaataggatatagggggaaaaatttaggggaaaccgctgtagacagtcccgggcaactggtgggtgtcgtcctcctctttgcgcagcaggttctcgcctccccctccccgcagcttctctctctctctccccccccccccccccccccccccccccccccctccccgccccatcgtcggctaaaggcgatcgtcccacccagaatttcccccctcccccgcaccccccgcaaacatcctagcagccctatcatcgcgccggtcccggcggcctgccggcctcctcgcaccctcccaggtacactccgcacgcggctccccccagttctctcagctctccccgtccaatccagtacaatccacgccgtctcgattggccgacgccgccaagtctgtgtggggtgcgatcggctcgctgggtgatcctgattggagtcgtggattcgttgggtcagatgcaacaggagtggagggggattacctttttttgtcgcgactgccgactggggtccgcgtatgcgggtcggggtggggggagcgcacgtggttagggattgtgaatttgtgatcgcagtacgaaaagctatgtcagactgggtggggtagacgaaccgggggtcatttcaggtcaattattaggtgctgtactatgatagcttcaatcatcttcggatctgccatatcgtgccattcactggtggaatatcttgcttacctcaagggttttaagtcttaatccaataatcagggtcttgtagccgtagggtttatgtcctagcgcgccccccatatatatacacacacacagtagacagtacaatgctcatgtgttgctgcggcacacaaaaataaatattacactttatctttgccaaaaagcctagaattgtctgagttgaaaggagccctgggtggttttcactgcctatctatgtggtaatggaccattgatagggggagaggaataaacctatgcgtttcgcgtttgatacaggacgatcgtcaaaactggtgctttaaagtagtatatatatagaatacgtatgtatgcatatgagccacctggttctgtttagcaaccagatccataattcagaggttcaggtggacccacgtatcattcaatcagtggcaaatttccaactgtatcatcttacagattctgtccataataatatcaaataccacattaatttggatttgtgatgaattgatgatgagatagtaattagatacaaatactactgccttcttttgcagcagtaagagagttactgttatgaataggaatattgttaggaggacggcatatatttttgttgtgggaggtagttgaatgaggctctagacctcagtgcggcttagggccagtttggtagaggactccttcctgaatcctgatgcttcttgattctgtgatgagagtgcttctggtggggaccaaggtggggagcagggtagggagtgattctagattgattctagcagtggttgaacagagagctatggagaatgttttttagctcccagttcgtaataacggagaagtgatttgcatcagctcctcaccagaatctagttgcatttgaactatttcgtagggctcttaggctctgtttgtttgagctgcaactttctaagcttttttgaaaagctgctgctgggcttttgattccgagaagccaacgatagctttttagtgatgttattaccttcctagactcagtaagctatagaaagcctataaaattaggcttctcagcttcccacataaactcagcttttctgagcttctggctttcaggaagctaaaccaaaaagctagctgtttgtttcagcttctggctttttacaccgagaagctggtgagaagctcaaacaaacagggaagaatctcctctgaggaagccgtgagtggagctgtatcaaactggcctttaggtgctgtggttggtcactgcacccaggaggctgggaaggaggaaagggataattgattcaatctctgtttggcttctaaaagtactattcctaggttggcaatgacatctgatgggaaataacaaacctccaaacttagccgtgaagccaaacaacatgctaccaagccaaaaaaaaattctaagcaaactgagatattcaagcatcacacctgtacttggccttatggctctgacgtacaggcttgcaccggggaacctggcctgcctcattgtggagactccacagttcacatgacagttgaggtcagtgcaacgttgtcaggttattatcagttattatagctataatgtgtcggtttctagcttcgaagaaagtatggatggaatgatgctaccttgaccctgacaaaaaaaatatagctgattctttattgcctccattgcaaaagatgttgaacccacattggtcaaagaattccttgcatatgaccaatcaccaaataccactgacactagttatatttggtcagttacattttttttacacgacctcttaataatttacccttatttaattgaacttctccttttctgtttgcagagtaatggattaatgcattaagcaaggtaatgaaatgtaccaaaagtgacttatggaaaagaaacagagcttgttcactgctctgaatgaggaactttaatctgatgcagtctcaaaagagcagagttttgggagcaatgtcatcctctttgcctattctgccaaatcctttgaaagggagcttctcaaggcctcataacccccagcatattcctatgttgaggcagctgcctgatgactctatgcccttgtgtattgacacacatcagtctgctagtttgcacccaagagctggtgttatcggggtaccatattcaggctacactgctagtccacttgattctgtgtctaaccttgatagccagacaatggctgcaccctttatttctcagtcatccaattttgaagctctccagtctctatctaataataccccagaaacacacactaaggcagcctggttcacatcttctatggatgtttcaccactcaacacagataatattgctgcttctgatgttaatcaaatccagagtatacgtcctgctatgacatctgatgagagtgctacacaaaacgattggtgggcagatataatgaatgatgattggaaagatattcttgacgcaacagctactgattcccactcaaaagtatgtgagtgcagaaccataatgagtaaacttgtagctccgtcttctgttcttttagtttagaaatactcttctttattatgacatattacctccgttctcgaatatttgtcgtctactagtgcatttttgaactaaaacacgacaaataaaaaagaactggggagtattaagtttgatactaaacctactggtatgtttgcgcaaatattttatgacattgaaactggagatttttttgctttgcacatactactgtgacagacaactgcaaatgaaggttcccttaccccttatgagaaattgagaagccatagtgttatgcaagtaattaggtctagctcttcagtttttaattgtttaggatgtcttgttgaagtgaccgtgaatatacgataagtgattcccaacatattatttgaatagtgatattgtacatgttagattgaccactagaggtaccatgttagaatcttttaagaacttttcatgttattaacgctaaatggttactgctggaaaattaaagtgctcttgccacatctctttggtacaatataggcgtcagttatctgattttaagatagttgtaggcttgtagtcctgtaattgtctgtgatactagttgtaatgacttatgtttttttttcatgactgttactcccttctgttataggccatgattcaaatttccaactcagctacatcactacctgcagtaaatcagtcagcttcatctcatagtagggagatttgtcctgttgctagtcctcccaatagcagcaatgcttcagttgccaaacaacggatgagatggaccccagaactccatgaatgttttgtagatgctgtaaatcagcttggcggtagcgaaagtatgtctgccctattggcatttcccctcaaatagtttaagttatgaaccctacatcacatcatctaatgcatgtgtttatttatcttttcttattcctattcagaagctactcctaagggtgtgctaaagcttatgaaagttgatggtttgactatatatcatgtcaaaagccacctgcaggtttgctgtttagctttctaagtagtattcttgcccaaaggaggccttttcattttcttatttgaactcgtttgtgttgcagaagtaccgcacagcccgctataaaccagacctgtcagaaggtttatttgcttggcctcttcccaacctattttctctgcgttgtggattacattttgcatgtgaaatgttggggtcatgaagctttcatcatatttatttatttgtgtcatgataaccatgtcgtgaggaattctgtgttgcagacagcatgcatgcatgtagctggatcaaaataagtgtgagttgttagtgttaatattacacttctttaaatcattatgcaggtacatcggaaaaaaggacagccactgaagagctggtcctggacctgaaaacgtgagtgagatacttgccatatgtaatccttcatttcacttgatggtgtgctatttgtctcttttgatggtaactgttaccatgttactgtgtgattccacatgcattgaagcgaagctctggagtttattcacatttgggttatggttttgattgacactcataatttagcttgaaagaaaatgctgtttgagattttcttttaggtgttactgtgaattcttaaggattgcacaaaataaggaggcacttaaatgctttgtattcaaggctaatggaaaacaacattctgcgtgtttgaaccttggtttgtggcttttgttgggtttcaactcttacctactctaacttgcttgggactaaaggctttgttgttgttgtatctggagttctggacatagtgtatatataagtgcatagcaaaagctatgtatttagaaaaactaaaacatattataatttggaatggagtatgaattaaagaaaaatattctttgtacatctcttgaaatgatggcagagtattaaaagtatcgtctttgccattttgattgctaattatttgccaatttatgcatgtgcaattggttgatacttgatagtggtttgaggaatatgctttgttttttgttcataatgatactaaagcgtgtctgggcatgtatggtttgctgtcctagaattgatctattttctgactgttctaagctgacacatttgcatccatcgatttgcattatttcccatgcagtaaagaattttgagggctatgaattacctacaagctatttcaaatctattcttgaagggcctttttacaacagaaatgcttatacaatcatggtctgggatttaacaatagatactccgagcatagatcatgccctcagtgttcgatgcatctgtcaagtgtcaacgccctcttctagttatggaattgtcatgatgtgcattgagccattgcattcacttttgttgcttcttttgaaacataaaatctaatttgaaggttttcctatatgttaaagtgcattttacgatcatcattgtctgttacttcttggtccatgatattgggcattcttgtataggagcatggatcttactgaagcactgcgccttcagatggaagtccagaaacggcttcatgaacagcttgaggtactaattctaaattcagttagtgttgattccacaaggccctgtttggttttcacggattggaggcctgtaacgattcctagtcggattgcttctctaatttatataagttttgataagctggaacgaatccttcctggacacaaacgaacgggccctaagtgattttgcccaacattaatattaatgccaatgaagcttgctttatcctaacactatatatatatatattcctatattgcagattcagcgaaaattgcagttgcggattgaagagcaaggaaagtatctgcagatgatgtttgaaaagcagagtcaatcgagcacggagaaagtccaggatccatcctcaagggatacaacagctaaaccgtcatctaatcagagccagtctacaaacaaggattgtggtgcaaccatggacccaaatggaacaggaggcatcgtacggactgcagaactgggagaacgttcgtctgaattaggtgtaaaacagaaactcgtagagatcgaagaatctggtaccgaagtagccacaggcgacagatctaagatctcccaagagaagcggcgcaaactgcaagatagttaacatatcggttgcactattcagacatagctgttcaaaccgtttgcttggtgaaaaattggtaatctgtgtgtcgaattcgactattgatccgtgagtccattggtgagttgtaccgctcttcagttagccatatatatttataaaggatccaaaggaggaccaaaggagaacttcctggcagccgtctttataacattagcaataagagctatccccgaagttatggggtaaaataaggtcttgaaatttagctttgtttctgaattcctccttttcttttgtttgggttgaagtggtcaccgagtcgatgtagatgaccacatgaatgaatttatcggaagcaagctagtgctgttccctattggcatagaaaccaaatattgaaacacgaacactgtttgatggtgcaaacttttagaatgtaattctgcatcgatttgtttggtggtgttggggtcttcaagaaatgagggagcgatagcagcctcgtataaagcaaatgtaacgactacggtcacttcttatctgtatgtgtatgatggtatatacccgctagagcatataattatggtcctaaatattggtacaacctatccatgtcaacaagctgccttatccataccaacagattagcataccaaagaatccaccaaaatttattgttaacagtttatcagataatatacttgtcaccgtagctagagcaaacttgagagggtttggctgtcttatgggtgtatagacactagatgagggtacatataaagcgaaaatttatgtatttttaggtgtagacgcactccctaaaacgaatatacattcaccccgattatgatacctaactattcgtacattctattcatgtcaataaaccatattatccataccaacatttttttttgtccacattagcactccaaacaatccactaaattttatttttaatagtttatctctttatacaagtaaatataagttgctaatttcatttaaaattatccatgatatccgcaactatgcgcgaggtacggtatccttctagcttttagaatttctcatcttcacaacttatttttaaattaaaagttatatatttatacacaagttttatcataacctttttattagatacattgttggaactccatttgctgtacaacatctttggaaaacttcattgaaataagttctttagcgaaagccatccaacatgtccctagtgaagatcacgttaacacttaagaatatggtacttagtgatgacaagtaaagtttatggctaagcatactataacacaaagaaataatcctagttgtaataactaaggacaaagaagatgtagaaagtgatcatgatgtcatgaatgacttcaatgacctataaggtgctggacttgaagaaaagtctattattattatatttgttatgagt

SEQ ID NO: 494 - protein, 450 aa, Zea mays
MRNFNLMQSQKSRVLGAMSSSLPILPNPLKGSFSRPHNPQHIPMLRQLPDDSMPLCIDTHQSASLHPRAGVIGVPYSGYTASPLDSVSNLDSQTMAAPFISQSSNFEALQSLSNNTPETHTKAAWFTSSMDVSPLNTDNIAASDVNQIQSIRPAMTSDESATQNDWWADIMNDDWKDILDATATDSHSKAMIQISNSATSLPAVNQSASSHSREICPVASPPNSSNASVAKQRMRWTPELHECFVDAVNQLGGSEKATPKGVLKLMKVDGLTIYHVKSHLQKYRTARYKPDLSEGTSEKRTATEELVLDLKTSMDLTEALRLQMEVQKRLHEQLEIQRKLQLRIEEQGKYLQMMFEKQSQSSTEKVQDPSSRDTTAKPSSNQSQSTNKDCGATMDPNGTGGIVRTAELGERSSELGVKQKLVEIEESGTEVATGDRSKISQEKRRKLQDS

SEQ ID NO: 495 - DNA, 3 bp, Zea mays
  misc_feature (1)..(3): n is a, c, g, or t
nnn

SEQ ID NO: 496 - protein, 3 aa, Zea mays
  misc_feature (1)..(3): Xaa can be any naturally occurring amino acid
XXX

SEQ ID NO: 497 - DNA, 2948 bp, Zea mays
aagaaaaccggcagtgctaatgatattttcactggcgattggcaaacaaccgcaagtgaaaaaggccgatttctactagcccctagcactggcggcactggaaaaacgcgagtgcaaatagctctaggaccgccactatagaacttttgtgtactagtgacaggcacgagtagtaacacagtactcaagcaatacaacaatcaacactacactaaaccagggcgaaagagtggacacgagtataactctctgtctcaaaccatctgctcgaattccaaacgattcatcattcggagtgagtctatgtggcatcccttcacgaacacaaattctattgtccactgattatctgaaaccatgatactgatcttttttatttttggttgtcggagtaatttatgtcctttttagtcaggtacaatctttctttcatatcaaaaccagttctttccttgattctttcttttaatgcatgcctttttttgaacttttgaaatgatagaattgacttttcagtgaccactatttaaatttctccttttaagctaagctactgtaagcgggatggacaatagtgatcttcaaacccagtactatatatatacgatcgcatagcctcattgaaaaaaaatctttaatgcgtgttagcattgatctctttgatcaaatggttgtgcattttctcaccaaatttattttatacttcatctgttctaaattatgtagatatagtgtacgtctaaatatatagcaaaatcaacatatgaaaatattagaatggcttataatttaaatcagagagaatatgtcactgcttttcgaagagcatgcagagtggaaatcccatgaatttcaccaatttgatacagcgaaaatgcaattcagattgttctctgcatgtgcttaactgctcatacacgcttccatgcaatgccatacgctgagtatatatacccgtcatgggctcctcccaaacccatagctctagggctgaaaccagcaaagccaacagaactgcacagtgtagtagttgcacataggcgtccgcgcgtcgtcctagctatggatccatatcactaccaaaccatgtatgacccacgcggcttccccatcatccacccgcagccttacctccagcacccggtggccggcgccctcggtgacagcagggtgcgcggcggcggcagtggcgcgcggcggcgtcctggcgccaagctctccacggacccgcagagcgttgcggcgcgcgagcggcggcaccgcatcagcgaccgcttccgcgtgctccgcagcctcgtccccggcggcagcaagatggacactgtgtccatgctcgagcaggccatccactacgtcaagttcctcaagacgcagatcagcctgcatcaggccgcgctgatgcagcacgaggaaggatgccatgctgagctcgccgcctattccgcggtggcggtggttggtgacaacgaggtgacactcgcgtcccatggtcgtaccggcgcatgcgacgagatgatgcagctccaggtggcggcggaggaagctttgagttatggtgttgatgcccatcagccgtacgggctcgatcccaggcagctgagtggtgggcacgagctgccaccgctgcctgcttcttgcatcttcctcgaggagcctgcagacgcatgctactctgtgtgtgacctcgacgacggggacaccggtctgcccggctcttactagagtagtagtagaagtttcttaaggtagcatcccgtgtgtgttggtgtctgctagacgctagtacgtctaattagcaaagtttagctagtactcgatcaattgtctgtctagttcgctcagagttaaagtatatgatgatgcatctgcatatatgggctctgtaattctgttatccgctgatcgcagatgatacaccgtatgtaatcacatgtatgtatgttgcctagctacttcctctcgtgtcgatcaagaatctgatctagctagatggtaaaactatagtgctgcaaactttctgtttttctcattaattaccctctcggtctcaaaagtaatttaattctataattgaacaaaatcaccttgtagtatgtcgtatgaaagactaaaatgactcattttaaatgcagtagtattaagaagggggtgtatctccaaagctagaaattaaaacaaatagcttcgcagttggcttttaaaaagttgggttgtgagaaaaatatgctgggaagttttttttctatcttttagtgtgctaagaagctaaaaatttaataaaaaaacaaaaaagtgaattttgagctgaaactctaaaagctacatctcaaacaactaagccttagggtgtgtttggtttagctttagcttttgccccctaaaaaccaaaagtcaaaccaaagggctgaatctggagaacaactttttctaaaagccgacttacttgtagtgcaaaactgaaagcacctctggacctgcttttagcagtttttaggtggaactgtgaaaatatatatagaagaatttttagcgatttttagtggtttccaccaaacgatttttagcttttagcagttcacagcccacaacagtttttttcacaactcacagcccacaacagcttttttcacagccacagcccaaccaaacagacccttagtcatatatggtcgtgttgatacctttggtaatctttagttaaattagaatataaatcatgtcaatttcatgaaatattagtataagtttagtttgcatactagtcagagataagaaatacaaacataaataccagtataatcatagctcatacactagttagattaaacaacatgaacataaatactagtgcgtgtatgcatagctcgtacactagttattaaccaatataaaccctatgcacgcgtgcataagaaaattaatgatgcgtcaatcagtaccatgaagta

SEQ ID NO: 498 - protein, 219 aa, Zea mays
MDPYHYQTMYDPRGFPIIHPQPYLQHPVAGALGDSRVRGGGSGARRRPGAKLSTDPQSVAARERRHRISDRFRVLRSLVPGGSKMDTVSMLEQAIHYVKFLKTQISLHQAALMQHEEGCHAELAAYSAVAVVGDNEVTLASHGRTGACDEMMQLQVAAEEALSYGVDAHQPYGLDPRQLSGGHELPPLPASCIFLEEPADACYSVCDLDDGDTGLPGSY

SEQ ID NO: 499 - DNA, 4001 bp, Zea mays
tttgattctcatgtttggcgtgacctgttgaacatcagaacgtactataccattgggagacaggttattattcgatcgggtaataaaaccaaattttgggaggacccttggatcgacgaaattcccctggctatgtctgaaccagacctgtatgatgtgtgtaatggtaaatatcttctcgttcagactgttagggagagggatggccagttgactttagaagatggttgaatgacgaaaacagaagtaattgggataaaattatggagaaattccaggcttttgagtttcaagaatcaggagactgtgtctccttgaaatggggcctgagcaaaaaaggagttgcagaatgtactacatgatgggggcaaaacttcttctgaaggctgcgaatgctaggaatgcaggaagagagctgcaagggagcaatgaagctggtgaccagacactggaaatggagtgatcgtcggtcgatgactgctgattggtcgtttggtgacaggagcctccattggctggacggtctttgttatgttgatttctggctgtgcgctgtgtcgcattttgttgcaataatttgactactttctttgggtgatgtcctactacttgatgtcatgttggtagataatgtttggtagctgtcgatgacctgaatcaggtcgattatgtttactttccttgtatgtcggtgcttgattgcttttgcgaccgaaacgtacggttgtatttctgttatgcaaataatagaaatggaggttcttcgtttaaaaaaaaataattagtaccgaaagatagagttttgcatttgcttctataataattttcaaaaaaatataaatattataaaaagtttttaaaattctaattaaatttgagaagctttaactgtagatgaagacgtgtataagaatgtcttgcactgtttataaattagggtttgaaatagaagttgagatagaaagtgaaacgggtgttcgagatagtcttataacttcaattatgacagcggccgccggccagcctgtgtctctctgagtggctcaccgcactgcgccccgtttcagagtggtagcagtgctgcgactgcgtgcacagggtatatagatagataggagtacactgcgtaggagacagcaagagggcgaggctgtgtgtgagagagggggaggcagagaacattcggcagtgtgagaatcggaatcggagatggcttggaatggccgcttcggcgacgacgaggaggggagcggccttgagctcagccttagcctcccgggctacttctccggatcgccaacccaagctgcagcaggtgccgccgcgtccttcatgtgcctcatcacatacgagctagttccatggcttggcttcaattaacccatcgttgtgttctgtgttcgcctggtggtttcaggtttcgaggacaaagcagacggcggctctgctgctgctgctgctgctgggcgagcaaagggaagcaatggcttcaaggccaggtaaccgatgaacctttcattctttctcgccgcctgtgcctttggttgctcctcctttctttttctgaaacgaaacccagaacagagttactgtcgtaacggcgcctcatcatctgaactatgaactacctcaaattcaactcctcaggccggcggcagctgctccggtcgtgggatggccgccagtgcgcgcgttccggcggaacctcgcctcggcgtcctccaagccgtcccgcgatccgccaccaagccacagaggaaacgagtccgcgagcgtcggcgccggcggcaaggccgtcgagggcggcaacaagggcctgttcgtcaaggtcaacatggacggcgtgcccatcggccggaagctcgacctgggcggccacgccggctacgacacgctaaccgccgccgtcgaccacctcttccgcggcctcctctccggtgcgtgcgtgcgcgcgcgcgcatcaccacgcaaccacgcgagttttgtatgaactgacgtctgacgatcgacctctgtctgcctttgccgccagctcaaacgtcgggaccaggcggcgagcggcaggcggtcgcggggatcctgaacggtggcggcgagtacacgctggtgtacgaggacgacgagggagaccagatgctggtcggggacgtgccgtggcagtgagttcgccccctctgcagcacctcaccagatcgcttctcgttttcgcgcgcttgctctgtctgctgacggaccaagctttcttgcgtttttttttcctttttttcaggatgttcgccgccaccgccaggcgtctgcgcgtgctgcggagctccgatctcaacccctcgtcggtcagtggacgctgcgctgaaatctttttgctcttgtgatattgtagcctggagatgttttgtaattttttttctcttgcttttgcagctaagggcagcgaccaggaagagagctgcagcttagtgctgcgctggcgtaccctggagtctcaactctgaacattttgcggccttttcggagggccaccaatgtaaaattgaagcggtttttcgtggatttttgttaccattaccatcatgtatgtgatcaagtagggaagcaggaatctagaggagatgagtggtgttgttagaatcacgtgtctcaacttatctgaaagtctaacaaggtgcctgtttgtttcggcttttgccagcttctggccaccaaaagctgctgcggactgccaaacgctcagcttttcagccaacttctataaaattcgttagggcaaaaaccatttaaaatcaacataaacacataatcggttgagtcgttgtaatagtaggaatccgtcactttctagatcctgagccctatgaacaatttgatcttcctccacatataattgtaatgatactcagattcttcccacagccagattctctccacagctagattttcagaaaagctggtcagaaaaaagctgaaccaaacagccccaaggtgtcttggcgctggagtgtatagttcatacttacatgggctcgccagggcccatgggccatggcattgtgctactgcttgcatcgctctggctcagctaaagccctacccaaattttttttagaaaagagaatattattaatattccagcttcggtatcggttgatacattcggctgtcaaactcacaaacatggggttccacattggaacgaaatcttacattctacaaaggtttcataaatttaagctctcaaactatgctctcaatctatgaaaaaaagaccatccattatttgaaaagatctccatcattgttgtttcaagcacacgacgcccattttacttgaggtctgtcctcctccttctgcaacagtgtccagaaccttgtccaatgtgtccctctaagtgacctgcaagggagtggaaacttgtgcattatcaaaaaccacatcattacgacttaaccatatagcccaacagagggcacatgctccaacccaaatcaggctcttaagtctagaatttaaaccttttagccaagtgccaaacatatgttggatgcacgaaggtggagtaatgttaaatgaaatttgtacacctctccaaacacatctagccatatgacagtcaaagaaaaggtgttgaacggattcatctaagttacatccacaacatttaacacttcctttccactgtttttttgctaaattatcctttgttagaactatgcctttaactaagtaccacataaaaattttaatctacaaaggtagctttaaatcccagatggggtggtttctcgaaacaatgttcggggcgactaaagccctatacatagagctgaccgtaaactgaccttgctggagaagatcccaaacaaacgtgtctcttcgatcagctagactaatagtaaatactctagctactaccttattcaaagcagctagattatttacattaagtgaccgacgaaaagccacattaagttgattatgttgaagaacattagctactgttgcc

SEQ ID NO: 500 - protein, 234 aa, Zea mays
MAWNGRFGNDEEGSGLELSLSLPGYFSGSPTQAAAGFEDKADGGSAAAAAAARAKGSNGFKARPAAAAPVVGWPPVRAFRRNLASASSKPSRDPPPSHRGNESASVGAGGKAVEGGNKGLFVKVNMDGVPIGRKLDLGGHAGYDTLTAAVDHLFRGLLSAQTSGPGGERQAVAGILNGGGEYTLVYEDDEGDQMLVGDVPWQMFAATARRLRVLRSSDLNPSSLRAATRKRAAA

SEQ ID NO: 501 - DNA, 5296 bp, Zea mays
aatactccctatgtcgagctcatcagttactaagaaaaactaaaggttggttggtgctagcttgcttttgccaatgcctcaatggtctgtgtgcatgtatatatatgttaggccttttttttctttactaatacgtacattttcatcgcctggtggtaataaggcaagtaagaccaactccagcagcactggctatcccactccgtatccctattatacacgctctgagtcactatttcgctctccagcagccttcgcatccgtctccgcaaaacacacgcagtgtacctgcactctccttttccacggtttctctctcctctccgcacaagactgcatgcgccccctcctgctcgcgggccccagttgtcatagactgcatgcggagtgcaaatacggagtctgctggaaacggagacggatacggagaggagagagaaactgttggccgtgctaaatacggatacggagagggagtctgctggagttggtctaaatactccaatgacacagctgctcaggttgtaccactccacaccacatgtcgtcattgcatgcatgctagctgccattgataaaaagatagatgcagaaactaaaggggggaaaaaagagagggaggggcatagcaatagcacgtctggctggatggatgggcgtggctttttggacctgcagagggagtgcactcgattgcagcatctctctctacacgtatgttgcccgccttgccctggctagctgcagcaactgcgcctgcagagggcaacgccaaaccgcctgcagactgcagtgcactgctgcctccccctgacgccttttttccccgatcctctcctgcaataatacaataataataatctgattgccctcctctcctctctcaaataatcacgcttggacagcactagaagcactgagctagctgagaccacagaaccacatgggtctactatatatagaagctaggaagtagagaggggatcagtagctagctaaagcttagcccggcggccggccagaactgcaagagagaagaccaagaaacagagagagacaagcgcaggggacagcagcgggtagctagctagctagcgatcgacgacagacgatgcagatgatgatgctctctgatctctcgtctgacgaccacgaggccactggatccagctcctatggcggggacatggccagctacgccctcagccctctcttcctcgcaccggcggcctcggccaccgcgccgctgccgccacctccgcagccgccggccgaggagctcaccaacaagcaggccgcgggcggcggcaagaggaagagaagccagccggggaacccaggtacgtagtagttaattggctgaccaatcacgccgaccgatgcacctaattaatgaatcaatgtgctacaaataaattaaaaccaaaagaccccggcgcggaggtgatcgcgctgtcgccgcgcacgctggtggcgacgaaccggttcgtgtgcgagatctgcaacaaggggttccagcgggaccagaacctgcagctgcaccgccggggccacaacctcccctggaagctccgccagcgcagcagcctcgtcgtcccgtcgtcgtcggcggcggcaggctccggcggcaggcagcagcagcagcagggcgaggccgcgccgacgccgccgcgtaagcgcgtctacgtctgccccgagcccacgtgcgtgcaccacgacccggcgaggtacgtatgcacggtcctgctcctgcatatatgcgagggaatgctagcgacatagcataacatctcatcgatccatccatccatccatccatccatccatccatccatccatccatcagagctctgggggacttgactgggatcaagaagcacttctcgcggaagcacggggagaagcggtggtgctgcgagcgctgcgggaagcgctacgccgtgcagtcggactggaaggcgcacgtcaaggggtgtggcacgcgcgagtaccgctgcgactgcggcatcctcttctccaggtacatctcatctcatgatcaccgtgcatatatgcatggacgacgtgctttgctgtaattgtaaacgctgatcatttttactaacaagcatgctggatataatagcctaaatctctcaccggacggatcgagagaaaacctagctagacgggatcgatcggtccagcaggttgccgccgacgactgttccatcgatcgagcctgttaatttagtcacaaaaaggatcgagcatatgcatgtatatgaactatcttccttcactgaccaacatcatatcatgcatggacctagttaatcagtacatatactcctatatatacatagtttttcaagaacattgggtgattctgaagcaacctaaatatatatagataccaaaaatatatgaagtcatcagcacgatctgcgagtgagtacggttcttgaactcttctgatggttgcaataatactaccaacaaaaatatactatatatttgtcgcccactaatttatttttaaactaaatcgcgactgataaaaaagaaccgatggagtactatatatacaagcgcatgtggccttcatttacaattttagggtttccatgcatcctgtcataaaactatttgcatgatcacatccctatatatatatatatatatatatatatatatatatgcccatagtactactgttgtgaaaaaaccatgagtccctggtcaaaccagtatatgtacatgcaatatgtttattgcatgcatatttgggaatgaacatcctctgcctgcaccaactttatggcagtcgtccatgtggtcatcatgacacattcccttcaaaaatggaacatatataggtacagcatatgaagcaattgaagagtactttaattgtgaaatagtactactgcaagtatatatgtagtagcacaacagtgcaataatgcagtgcattagatatagtagtgaagttaagagttagtttccaaatcttttactagagagatcataaaaaatctataaaaaattctaattcaacttctaatgtatcttatgttaagaaagagatatatataaaaagagtaaattctgtcattagatacatcgttagcagtagtaccactgaatttaattacgtcctacacacacgcgcacacacatgcatgcatgcatctgcatgcttcttttcagtagtgatcacaaaggaaactgacaaaagaacctagctaatcataggacgcagcttttcgtcatcaaagttaaacgaaactttacatgcatggattgcattgagtactcacgcatgtgcacgtcaacacgcgcacacatatacgtatattaacatagtactttatataccaactaattaataaagtcattgactcctctgatcatttgtttagctaattaacccgtttcgtttgatgcatgcatggtctctctggcgtggtcgtgcaggaaggacagcctgctcacgcacagggccttctgcgatgccctagcagaggagagcgcgaggcttcttgcagcagcagcaaacaacggcagcactatcaccacgaccagcagcagcaacaacaatgatcttctcaacgccagcaataatatcacgccattattcctcccgttcgccagctctcctcctcctgtcgtcgtagcggcggcacaaaaccctaataacaccctcttcttcctgcaccaagagctgtcccccttcctgcaaccgagggtgacgatgcaacaacaaccctcgccctatcttgacctccatatgcacgtcgacgccagcatcgtcaccaccaccggtggtctcgcggacggcacgccggtcagctttggcctcgctctggacggctcggtggccaccgtcggccaccggcgcctcactagggacttcctcggtgtcgatggtggcggtcgtcaggtcgaggagctgcagcttccactgtgcgccacagcagccgcagcaggtgccagccgcaccgccagctgcgccaccgacctgacaaggcagtgcctcggcggccggctgccgccggtcaacgagacctggagccacaacttctaggcccgctatatacttcaagctgcattgagactttgagagacgaatgaacggaacacccaaactgcatgcactctagcttgaagagcaaccaaaactggagtagcaagtatggtgcactactgttgttaatttaccttaatttattgatctctgttagttctattttcatttagggcaatgcgggctagctaattaattcgatgtgcacaacttttgatgaatggaccagaaagtttatcttgttgctttttttgtttgattatgtttcgctgagaggcatgtgttctcataatggtatgtcgaaagaaatagatgatatactaatataaccatatcttatatactagtcagtctaaacaacatgaataaagattcaatcaagctagagtagtgacatggttactgatgatgatgctacggagtcatcgataagtggtagtggaggaaaagcttggtgcaactggcgacgaacacgaccgcttaacttggatgaacacgacaactcgtcgtggaagttgagagcagtcatgcaaataacacttgccaaaaaccttattaaatccatcctctatctgtgcaaggttagaaagatgagtgttatggatcgagatctactctccctattggtgatgtgcacgtaaatgctcaggatgaagagggctatgacggcagcgcagcattgagaatggaaaatactattaattgactatctcaagatttttcaaataaagtaggagctctctgatagtagttttagtgtgtcttttttcaaaaagatcggtatatatagggagaactcctgccttcgtagtatcaactagcaatacaatattgattgatgttgcatcatccacctctctactcatagactttaacataaaagaccattagaaaaaaggtattgggtcgttgagatttattagaatttctgtgcatgaacgtaggagaactagatcataaaaactttaacaggatcttcgcctaaaagttctcattgagataattgatgaagatgatacatgaattgaagcatcttgtgttttcttttgtattggatatctatccatgtgattggtagcctggctggctatgtgcagactcagcgggtgcattgactatggtcgtgcacgtgattggtcccttgcgtagaacgagacgagcctgctcacgcgcatgcaacacagttaattttttcagctcccgcttgcacgcgtggggatgcgggga

SEQ ID NO: 502 - protein, 436 aa, Zea mays
MQMMMLSDLSSDDHEATGSSSYGGDMASYALSPLFLAPAASATAPLPPPPQPPAEELTNKQAAGGGKRKRSQPGNPDPGAEVIALSPRTLVATNRFVCEICNKGFQRDQNLQLHRRGHNLPWKLRQRSSLVVPSSSAAAGSGGRQQQQQGEAAPTPPRKRVYVCPEPTCVHHDPARALGDLTGIKKHFSRKHGEKRWCCERCGKRYAVQSDWKAHVKGCGTREYRCDCGILFSRKDSLLTHRAFCDALAEESARLLAAAANNGSTITTTSSSNNNDLLNASNNITPLFLPFASSPPPVVVAAAQNPNNTLFFLHQELSPFLQPRVTMQQQPSPYLDLHMHVDASIVTTTGGLADGTPVSFGLALDGSVATVGHRRLTRDFLGVDGGGRQVEELQLPLCATAAAAGASRTASCATDLTRQCLGGRLPPVNETWSHNF

SEQ ID NO: 503 - DNA, 31929 bp, Zea mays
ccgttttgcccaaacattaccccgcagacttcatcacgtgcacggcgtacggtgcgcttaaaaaagcaaaataaaaataaaaaccccgacgagccgcatactccaaacaatctgatatctttaatgcttgggcaccgctgcacgtggcaccagcacggccgtgcaaattaatttgaaagcaaaacattccgatacaaaaaatgacaacaacgaatctagttagatctatttaaaacaatacctccattctcgaatatttatcgtccactagttcagtttttaacgcgcgcgacaaataaaaaagaactaagaaagtatactactccactaccatcctaatgcctactttgagtaatctagtattgatcctaatccatatgtattaaggtggtttgcagtataacttaaactaatttacatataatccacctcaacacatatggattatggtcaatactagagtatccaaacaaagcttaaggattgtttggtttctaactattttttaatccatccattttattttattttagaccctaaactaataaatacgataactaaaatagaacccaaacacccatagagactaaacaccccctaaaacaagtcttgttctcatatgttagagtcaaacgtttttatttttaataaaacatataaaaataacactaatagttttaatatataaatagaattaatagatggagcgttggtttttttgtgtaataaatttattcgaagatactactgctaatactttggtcgaaaataaatgttatagcgatattcattatagctaccagtagtcgagtggagtagatagaaacaaaaacagataatagctgctgcctgccagcatcttgtcgtcattacttcatgccaggcaaggtgtgtgagagaagccggtttcgaccgtacgaggaaagaccctggcagcgggcccttgcgatgagagatgccgtggggccaggtgggcccgggcacgccgcatcggccaatgccagttcgacagcggcggcggggaaaccatcccggtttcgctataccccctccccctccgatccgtcgcggcagcgctcatcaccgctttaaatccgcctcctcccagcgtctccctcctcccggcctgtcccctcacctccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatggtacgctctcggccccctccgttgcttacgtttcgacactgcccgctgcgtgctgccccatttccaagctgtttgaaactatgaattgaggtgatgcgtaattatctctgttcgaatttgttgagaatttttggaattatggttattgggtagacagacgtacagctctggttatgtgtagatgaatcgaagaggcgtgtagcgtgtcccgttcgtgcgcgcgctatatatatacggggtaattttatgctccgctttcgctggtatggcgttggtactgctctgtttgggggaaatttttgctgccatgctgcatgtgctaattgcttgactaacttgacttctccgcagaacaccaatactatacatctcatctcgcccttattctgcacatctcatcttgtactcagcacccttaatctgcgactggggaagtggggattatatggagaggagtatagtttctgtaatttggatttttctcatccaggcctggcagcatcagtattatttaggttgctgctgcctcgtttcttcgccgaagtgctacttaatttgtgtgactatttcttcgttcttacattttttcttctttctgtgccccttttctgattggcgctacttgtgggcgctccccatggtatggagatacatggaatcgtcaactgccacaagcaactatgctagcttgtctttactctttgctgatgactgacgatgctgagtctgaaccctggtaggacacgctcatatcgaaagcccatgctgcacttaagtttgtacgtagactttgttcatttgatattgttatgtgctacatatcactgttaggttgccatgattttcttgaatgaacagataggcacacgcacgcggattcctactttctttatttattaactaaaggggacctgcctagaaaaaattaaattggataaattaaaaactacttctaactatgttctttaatttctacctagttaaaatttatacaataaataacttatctagattcagaactaaaatttaataggtgtgctaccataaaccgaagtgccgtcaacactcaacaatgaaggtagtgtgcacagacatcaccatccaaagtggcagatgcagaacgacaattcacaggggtcaagaaaatcacgtgataaaatcaagcaagaccctacaggtgttttatagaatttaagttttatatcaatagatacaagttcaaagaagaaaactatataaacaaaagaagcaaacatgttgctaaattcttgttgtccgaattcaagccatctataccttgtcgaatgtcgatctcctcgggcaggggcatcgggaaggggacagtgtcaagtgaactcttcggcagaaaggcatagctcgctggttcaccaagctcgccgtgggtcgaatcgttgcaacaagcaagatcgggcttgatgggcaggctagcgttgcgacgacgacgacgagcaggatgagggtgttgggaaggggttggggtcgggctgcatcgcatatcgggaaggaggcggttgtggtggactggctcgagcgatgtcagatagaatagggccaaacagatagagcgaggactcgaccaagaaggaatggaggatgacggaagtcggaaggagtgacctatccgacgagaagatgcaggacaaggctggtttactccacctaaaacttcatttactgattttctccacctaaaactttattttttctatacttaattctaaatgaacattaggtatagaagattttacaaaattgagaggggcatgatccacttcgcctcctctatagatccgctcctgaccatcactaaggttttcgcccaaagtagccctagtgcaaacgttgggccaaaatgccaaatcccttctcttccatcaccatcgttgttcttgtcctaccagtccacacaagtgtaagatccccttggcccctagggttcgcctgggcatgaggatctccttctgtcggttagtccgttaggagctggaactcaacaatcatgtatgtggattgttgtttggtttattcatttcatgcctccttacaatctcttagatttatagtgctcataagtgagctggcccattaatcaggtgattacaactcaacactctaatccctcaacactctaatccctctttaatcccttataatctcttctaatctcacggcaccgccttacgtgagtctatatcatagatatacaatcgtgacaacaagcctcttgagaggggcatcgacacacctactgcatgcatcagtcgcatagctgtgtaggctgccaccccttccgattccgaccagacatcgcacggaattgattctgccgcacacgtaacaccttcgcatgccaaagtcatcgccggcattggcagtttggcactcagggcgtgtttggattgcttccctgtgcagccaaaccaaagaaaggtcgttgatcgttggcagcgtatatgtttggatgcaagcagattattggcgggccaaaaagacaagcccatcttcttagctatttttgtatgccaaaacttggtggcagcagccaaaatttggctggccaatcatgagcacaggtagctttagcctcaatccaaacataccctcaccgccggccctctagccgccgccaagcgcgtgccctgtcaggcgctatccctgccctgtaggcgttgggtctaaagatgggaatgggggatctgattccgaatctccacggagaattcttccattagagaatcagaaagtttcttctcccacataatgtaaatgggaaaaaaaatcttcgacgggtaaatggagacgaggaaacattcctcgtaactgttccccgtggggacccgttaaaattatatgtgatacgttttcatgcaatagttaatgataaaagtaaataattaacttgtgaagagatcacttattgtataaatatgtttattttgatgtacatataatgatttcttatatctaacaatgagtataagtgacaatattttatattaataacatatgaaatacgttctagttataatttaagcggagatcagatctcgacgggaatttatctctacgagaaacgaggatgattccagcgtaagcgttcagtagattccagcggagaaatttttttaccgcgaggacagagatgagaggctaaaacccgacgaaaatccctcattgccatctttagtcgtgtccgatcgccagagcacttatctggatgctcctggccggcgccagcgccgctgcccccactatggcctggccacaattgcaagcgccgtccgttgccccctggggtgtcggatacggtccccagggcaccggatccagcggcccaggctggcaccgctgccgccgtcatggatgtggaggaagaagcaagatgaaggagctctcccgctatctccttgcctaagccctaagcatgggcattggccgtcgctgctgccgcccaagcagacgaccccgctgagccccacgcagatgacgcgagagcacgacccgtcgcccccctaccgcctgcaccacaaaaacacgaggaagagccccgccgccatcccggctagctgcatggccatgccgacggcctccaacagcagcatgccagcatggtgggagcaactcaggggctcagggccgtgtatttatgctacgcataaaagggtttgctatgtttcattttgaagacacaaagattggcatggaaattagctggacgcctggacctaaccgttctttcatctttattaactgatttttttgtgaacataatcttcagaaaaggaagtatgtatttggcggcttggtgccttgtgctgcgatgctaattctttctcagagtcacggacggaacagggcgaggctagcaggggctgtagccccctgacaatgaaaactttttaaccgttcttaaaaaaaaaatgcataatgcaagaggatcatctttcagttaggtgaaactgtatccgagaaactgatgcttacccaatatgcattcatcctagcacctctagctcgacaacgaatagtagcaccttctctaccagaacctcagttatgttttcctatctattttgatcccatttgcacatatcttgaaaatttcaaatcttcgcagtttcaaatgaaaaatataacagataatgaatgctaattacatgtatgcatctcaatatcacatgtgcgattttatttctactgtttgccattgagtacctatactgaaggtagaacattcaccgtataaatgttcgtgtatgatagtgcacccctttgttctggattacgttgatcagaattttcagttgcagtttttcttattgttgacatggtcctatactcctatacttgtacgagttcgcccaaacttatcttgcagccaactttcaaccccagatgttttttttgcactaattctggtgttctatagtggctttctttatcaacttcttgcaggagcttagctattgcttgggaaaccccaaatgcttttcgtttagttttagtatatatttttatctaaagtggccttttcaaggcctgaagctcagcaaatcattgttactttttgtataaaatttaatggtttgtgcatgtatgcttcatgatttgacaataaaatgggaaccatgttcttactgtaacccgaggaaaataactctatctttctgatatagcctttttgtcgtcattgttatcctcatagtggcgctaggtcatctgttgtatgttggtaacttcatattaatgtatgtagacatagtcatgatggtgtatatttgggtactcgtttactgaaaggacatgtatatagggcatatgcacgatcctttatgtatatagttgatcttctggatatgaaaccaaattggttcatggagatcatcattatttctctcagacaatgctcgacaactctttcacatacctttgtagtgtggctcatcaacttaattctcctgtaattggtacaactttaaatatctttgtagtatggctttatcagcttcatagatttaatttaacaaaaacaaacaatggtaaaggtggaaacatccctacctgatcttttttatgaatgtgttccctgctaactatcacaagtttgtataagataattttatagtaatatccttcaaagttttaagaagatatagtctattcagtcgatatacaaatatgttaactgcgtaggagatgagagaaacttcagtttgtatatgatgatgtcaatattaataagcttttgagatttgctaactaatcgtataatttaattttagttcatacactgttccatggaaattaagtcactacaaacagcaaacgatagttttggaacattaatacaaaatattcattcaaaaacataaaataaattatatagggatgttcaccatagcaatttctgttgtttggagaattttttattttacatcaagattgcttaacatgcttcagttttatctacacagactagtatatatgtggggaacttccacataccagaactgattgaaagagctagatacaatataatgcagtcagaaaggttcataactttatttgacttaatttactttttatgtatcgttgtcttcttaacggttgttcttgacgttgttgtgaatgcgttcaaaattaatgttgtatcctacttctgattattagttgacctgttgaaccaagtacactcacatgtagaaaaaggaacaatctttagttagtctatgcatatatatattttatatatcatatataaatattatattatggtttaagtcttgtaggacataaaggtgctatggtaaatgttacatcaatgaatataatcctaccattctctaccataattatatattgttgtcatgttgtgcatattgtttagttattcatgcttacagtgattcacttccagttttaacttgtcatttccaccttttcacagtatggacaaaattcttgaacggtatgagcgctactcctatgcagaaaaggttctcatttccgcagaatatgaaactcaggtaaattcaatttcctttaggaacatatgaagctgtttttaattgttttataacttcattcaatataacaggctctatttgattcattactatagctttttggcttttgttcatcaaaaaaattcttcatgtcctatcaagttggatcagaagtttaggaacatgggtttacttaattcagcctatattacgcctatattactctgctgccaaaagtggagaatgcttcctataatcctatgtgaaggattttcgacctatcaatgttttgcatagttttgccaagattgtttgttagctaataggctggcaagccggttataatctatggtctcccccaaccagtctgcgttcattaaaaaacgattcatacttgacaacttcatgctagttcaacagatgaccaaattcctgcaccagcagcgtgaggcccatattctcttcaaattaaacatttctaaggtgtttgactctgtgtcttgggcctaccttcttgaagttttgaggaaattgggttttggtcagaaatggtgtgacataattagtgggttgttgacaacctcttcaacaaagattctcataaatggtctgccatgtgagggtcttagacattagaggggcttgaggcaaggtgatcccctttcccctatgctctttattcttgtcatggacgtgctgagtttgctaattcagagagcttcgtcggaggggctgctgcaacccctatcatcatgatctctccagcacaggatttctttgtatgttgatgacgtcgttatgttcctaaagcatattgcttctgatataaatttggtcctcgatatcatcaaactgtgtggtcaggctttaggcttaaggacaaatgtccaaaaaagtaatgtttatcctatttgttctggcgatgatgatttgaattgtgtgcagaatctgctcccttgccctatctcggtatttccatgtaagtaccttggactacctctgtcggtgagaaagctatcaagggtacattttcaacctatagtggaccggggtggctagtcttttgcgaggttggaaggcagagttgatgataagggcaggtagagcaacttgtgtgcagtttgtgatgacaacaaaattgatttatgcatctttggcattagatctcccagcttaggccattaaggcgattgacaagttgcgaaaaggattcctttggagaggaaggaggccaaggctagccattgtcttctagccttgctgaaggttactaaacccaaagatctaggtggacttggggtcagtgaccttcggaaccttactgggttttgtaagcacgatggacatggttacaaaaaactgatcctagtagaccatggtcttctttccccattcatgtgtccggaagtgcgatctcttgtgggagtagtagttgcgacacatcttggggatggctctaacactcttttttggaaggatcactggttgaatggcaactatatccaagtgttagggtaataatcattggattatcagggccaaccctagagggtggctatatagagtttatacatgggccacatgggcttagcctcatgggcctaatccatatactctaacacccctcgcagtctgaacttccgtcgcagcggagttcacagactggactcgaaaagaagtacatcacaccataggatccccccacagactcaactagccactactgatgttgaggctggagcgaaactcgacgaaggtcgaggatagaagacccttggtgaagatgtcggcaaactgagaggtggtcgagacgtggaggacccgaacatcaccgacggcgatccgatctcggacgaagtgtagatcgatctccacatgcttggtccgctggtgctgcaccgggttggtggagaggtagacggcgctgacgttgtcgcagtagaccaacatgctcctggagaggggactgtggagctcggcgaggagctgccggagccacgcagcctccgccacgccgttggccacgacacggtattctgcctcggcgttcgagcgggagacgaccggctggcgcttcgacgactaggacaccaggttaccgcctaagaagacggcgtagccggaggtggagcgtcgagtgtccgggcacccgacccagtcagtgtcggtgtagacgaccagctcggaggaggtagaccggtgaagaagcagctcgtagtcgacggtgcctcggaggtagcggaggaggcgcttgagagccgcgaggtggggctcccgggggtcgtgcatatggaggcagacctgctgcacggcgtaggagatgtccggcctggtgaaggtgaggtactgaagggcaccggcaagactcctgtacctagtggggtcctcgactaggtcacccttggcctcagagagcttcgcctgcgtgtcgactggggtagagcagggcttgcagtcaatcatcttgacccgctccagaatgtcaatagtgtactgccgctggtgaagtaggagtcctgaggggcgaggctcagcagtgacccccaggaaatggtgaagcacgcccagatccttgaccggaaactcctgctgaagcgtgtcgacgaggcggcggagaagtgactgactggaggcggtgaggacaatgtcatccacgtagagaagcaagtaggcagtctttgctccatgatggtggatgaacaaagacgtgtctgacttggcctccacgaagcccagtgtcacaaggaacgtagccaatctggagtgccacgcccaggggggctgcttgaggccatagagagacctattgagccgacagaccatgtcagggcgagaggagtccacgaaccctgccggctgacagtagtaggcggtctcggtgagggcgtcatgcaggaaggcgttcttgacatcgagttggtgaactggccaagagcgagcgagggccagcgagagcaccatgcggacgatggccggcttcacaaccaggctgaaggtgtcgtcgtagtcgacttcggggcactgagtgaagccccgaataacccagcgagccttgtatcgttctagggtatcatcggcccgctgcttgtgcgtccagatccacttgccggtgacaatgttggcgtcgggcggacggggcaccagatctcacgtctggttggcgacgagcgccgtgtactcctcttccatcgcccgatgccagtgggggtccagcagggcggtgcggacggaggagggtaccagagagacctgtgagtccccgggcgtggccgccagaacccggggcggcagggtactagccgcgtgccgcgtcaccatcgggtggacgtgcggcgggtctcggtgaaggagcggtgggtggtacaccggcgtctggacacgtgccgcgggtggccgcgacggaggtgtaggtgtccctggtggggactgggccaccagcggcgccgccggagaagaggtcaccggtggggacgacgacggtgggggcgacagcggtgcgaaccctggcagtggcagcctgcgctggtagacgcgtatcggctgggcaaagcgtgccggagggaccaacggcggcggtcccacggccggcgacgtggtcaccgggggccggtgccgacaccaccgtaggcgacaccaccggacccgggcaaggcaccgggctgggagtagtagcgacaggcggcgagcgagtacctgcagcaagaggaagtataggtggctcgaccaccgtgtcagtcggaaagggagtgaaagatcaaggtcggggtcgggggaaggtggtgtgggtgtggtggagtaaggaaaaaaacggactcatcaaacaccacatggcgagagatgaggacccggcgagaggagaggtcaaagcagcggtagcccttgtgattcggggagtatccgagaaacacacagagggtggaacagggtgctagcttgtgaggagcagtggcagcggtgtttgggtagcaagcacacccgaagacacggaggtggtctgacaccgcccgtggccgccgatgcgcaacttcggtgacgtgagccgcgccaaatccagcaaaggagaggaacagaagagaagcgctcaaactcagataagtttgttgggattctgtttctatttctttcttatccccagatccacaccagattacagcttttatagtcaagctaataaggccggcccactattacaaggctaattagccacattgacaccccaaatcctggcttaacagcccatttacaactccacgcaaatcagcacaaagattaaattgccataccagtagcagtactaacacttgccccccccagaagagcttgattgtccccaatcaagagctgtaggaaaccggttcttcaacacttcatagtcctcccaagtggtaacctcagctggcatattggaccaagtcacccttacttgcaccacaggatgattacccttgttcaccatcctcctttccaccacagccaatggcttaacctctttaacagacagatcaacaagttgtggtaaatcagaaaacaccggagaataattgggagtaaaagccttcagctgagatacatggaatactggatgaatcaaagatgtaactggtaaatccagcttataagcaaccaccccaatcttctgtaacaccttaaaaggaccatagaacttataagccaatttaggacagggtcgactaaccaccgacttctgcacataaggctgaagctttaccaaaacgctatctccaatctgaaactctctgtcagatctatgcttatcagcctggagtttcatcctattttgagcagctgccaacttctccttcagcatggtagcatgtaactgtctgtccgccaacacctcagtcacagaactaggagcaaccccagaaagcataggagcagcagcaaacacagggtcataaccatacaaggccttgaatggagaacaccccaaagctgtgtgatatgaagtattgtaccaaaactcagcaagggccaaccatttcttccaagtattaggtgcctcatgaatagaacagcgaagatacatttccaaacactgattcactcgctctgattgcccatcagtttgagggtgatatgcagtagtaagagccaatttgatccccaaagcctgaaacaaagatttccaaaataaactagtgaacactttgtctctatcggaaaccaaagactttggtgtcccatgcaacttgataacattgtcaagaaacacctgtgccactccaacagcagtgaaaggatgcttgagggggaaaaaatgagcatatttggaatatctatccaccacgaccaaaattgtatcatatccctcagatctagggagaccttcaatgaaatccaatgtaagatcctgccaagccccttgaggcactggtaaaggttgtaggagacccggataatgcaccctttcatgcttagcatgctgacacacctcacattgctgcacaaactgaaacacggctgacttgagccctttccaccagaacaacctcttgatcctttggtaagtggcctcaccaccagaatgtcctcccaccacactatcatgcagggctgaaatcaacttagtttgaagggcagaattgttagctatccagatttgatccccttttctaataataccttgatgtaaagaaaaaccttgctcattaggactggccagggccaattgagccaatagatcttgagcctctttatctgtcacataagcattcaggagttcttgcacccaagctggtttcacctcagtcaccgtgtgaatctgcatcacatgaccaatcctggatagagcatcggcaggcacattgtccttgccttttttgtaaacaattctgaaatgaagccccatcaacttagccatagccttcctctgcatatcagattgcaaaatctgatcatccagaaaactcaaagcctgatgatcagtcttaatcacaaattcagccctctgcaaatattgcctccacctgtccactgcaatgattagagccaaaaactctttttcataaatggagagcatcttattcttagcacccaatgctttacttagatatgccactggtctatcacattgcatcaaaacagcacctatcccatcatcacaagcatcagtctccacaacaaataactcatcaaacctgggtagggccaacacaggagtagtaagcatagccttcttcaacgcttgaaaagcctgatcagcctcaggactccactgaaaagccttatgcttcaacagattagtaaggggttttgcaataatcccataatgtctcacaaatctcctatagtacccagtgagacccaaaaaccccctcaactcagttactgactgaggaacaggccatttctccatggctgctgtcttagcaggatcagtggccacccctgtgtgagaaataatatgtcccaaataaatgagctcattcctcccaaacacacatttgctcctcttcagataaaactggtgctctctcaaagtctgcagcaccatcttaatatgagccaagtgtgtctcccatgtatcactataaaccaaaatgtcatcaatgaaaaccatgacaaatttccgaagaaaaggagccaaaacagaattcatcgcacattgaaaggttgcaggagcattggttaacccaaaaggcatgaccctgaactggtaatgaccctgatgggttttaaaggctgttttatgctcatcaccttcccccattctaatctggtgatacccagcagtaagatccagactagaaaaatatttagtaccagccagttcatccagaatctcttcaacaagaggcataggaaatctgttcttaatggtcaaagaatttaatttcctgtagtccacacaaaacctccaagtgctatctttcttcttaaccaacaataccggagaagcaaacgggcttacactaggaacaataagaccagccttcaacaaagcagccacttgcttctcaatttcatccttgtgaagaggagaatacctataaggtctggaattcactggtactgctccaggaaccaaaggaatatgatgatcatacaccctagcaggaggtaactgagaaggcacttcaaacacatctccaaactcctgaagtaactgctgaagatccccctgctgctgtactccctgatattcagacacttcttccaacaccactaaagcccaaatatcatgccccttcacccatttgtgcaactgggaacctgtcacaggcttcaccttcgcatccccagcctcctcatcaccctgcaacactacctctttgccccctattgtaaacttcaaaaacttttgttcccagtcacattccatagggctatggtatctcaaccaatcataccccaaaatagcatcaaaagcactcaaagttaaaaccctcatatccgtatgaaacaattgtgcaccagcccaccattccaatcctttcaccatagtattactgaccatagtctctccatttgccactttgactgtcacagctggacaaacttgcacagtcaatcccaactgatgcaccacatgactactcacaaaactggtcgaactgcctgagtccaccaacatcaacatcaactgtttctgcactaccgctcgaatcctcatactgttaatactgcctgtaccagctagagcctgcacagataaacgacaacacaactccttaacttcatcttcttgtgccaactgctgtaatgtatcatcagtcagtatctcagacatatcctcagtagccactacatttaactgcagtgctccacgctttgcacatttggcaatatgaccaggctcaaacttttccccacaagcataacataacccattaagtctcctgaaatccctaagttgtcgtgctcttgtgagatctgccccgagtccttggtcatctgttttctggccagccacaggttgtttcacatgcatagacaaccctgaccgttgtccccgaaatttattgcgctccaacacctcctgttgaagctgagccaaatgaatagcacggtccaccgtagaaggtgtttgaacctgcaccacatcctgcaattcatacttaaggccccagatccacaccagattacagcttttatagtcaagctaataaggccggcccactattacaaggctaattagccacattgacaccccaaatcctggcttaacagcccatttacaactccacgcaaatcagcacaaagattaaattgccataccagtagcagtactaacatggtcatagcgcggaggggtaccgaagagtgcctggtgaggagtgggggccgggcacgcagtggaagggagacgattgaggaggtaggtagaggtgtggaggccctcggcccagaagcgtgccggtaggtgtgcctagagaagaagagtgcggatggtgtcgttggtcgtgcggatcatgcgctcagccttgccgttctgggaggaggtatacgggcaagacatccgtaactatatcccgtgggagagaaagaagtcacgggaggtggagttatcgaactcccgaccgttgtcacattgaacgaccttaatggtgaggccgaactgagtggacacccaggcgaagaagtggcggagggtggggaaagtctcagacttggcacgcaacggaaaagtccacacataatgagaaaactcatcaagcaccacaagatagtatttgtagcccgacatactggtaataggtgaagtccacaaatcgcagtgtacaagatcaaatgcatgagtagcatgcgaggaagaagaaaaagaaaaacgaacatggcggcctaattggcacgcatgacaaagatgctcatcaggtgatctagtacatgggatggtggcactacgagtaagctgcatcaaggcatcacgtccagggtgaccaaggcgacgatgccaggtagtagaagatgtggcaggtggcaaaaacagcagttgtgtcaggcgacgaagacgaagaagaggtggcatgcgggagccaaagggtgtagaaggggccggtgctgtcacatctgaggagggggcgccgagttaccgagtccttcacagtaagaccagaagagtcaaactcgacagaacaagaattatcagcggtaaaacggcgaatagagagaagattgtggaccaaagaaggagcgacaagaacatcgggaatgcgaaaatagccgggagcgccggcggcacccacggatgtgataggaagacacgagccattcgccaccatgatggacgaagaaagagaggaaggagggcgaacagaggtgagtataccagggttgggagtggtgtggtaggtagcaccagtgtccgcgatccactcgggacccatcagcggagtcagagtaggagtctagaaggcagcaagggcggccgtgtcccaaccaactggcccagacggtggagcagccggcggcgtgggccacgacgtagcggcaggtgtcgaggtccagggcgacggagaggcaaaggtgaaccctggcggcgaggtgaaccccggcgaacatggccgccgggggacgagcctcagaacctggcccctgtaacggccacatggagatgcgccctgaccacgggtggtagaaggtgggccaaggggcaccctactggggtcccggcgtcggtgcgttgccacgggcaccgccgccggaaccgccaccaccatcgctgccaccacggcggcgacggccaccaccgcccccgcctccgccaccttggcccccgccgccctcgctttgcccggatggacgagggccaagggcagactgtgatggagtaggtggacgggtcggggtggtagccgccagtgctgtcgaggaagacgaggacccgggccggagatcgatgcagcctgagcacctagagtgatctcctccagggcaaggtcgtcgcggacctggaggaaggtagggaaggggcgctagcgcatgatcaacgactggaggtgggtgtagcgatcgctgaggccgcggaggacgttgaggacgaggatgctgtcctccacggggcagcccagatcgccaagtaagtcctacatggtcttcatcttgcggcagtactcactgacgctgaggtccccctagacgaaggtgcggaaggtcgcgtcgaggcggagagcctgggcctcggcgttgcccaggaactggccctcgatggccagccaagcagcccgagcgtgaggaaggtttcgaaggaggctgtggaggtcgacgaagatcgtccccacgatccaggtgagcacgatgttgtcgaggcgcacccacgcggcagtcggcgccaagccggtggggtcgcagaggacgtggtcatccagggcgtagcggcgaagggtgaggaggagtaggtctcgccagcgtgcgtaggacagcgactcgggctccaggacgacagggaccatgaggcgaatgttttggacactcccagcctgaaggtggagctgagccacgagcgggtcagccgggtcatgccagagcaccgtggtggtggtgcggtgcccggttccaacgatcgggacgccgtacacgacgcccatggtgttagaggaggtggcccgccgtcgtgggccacaggcgaggcaaggagttgttccgccgcggcaatctgagcagcgatagcgtcagcggcctcgcgctcgcactcccacatgaggaccgcttctcgcagacgggcctgtcgcgccgcgtgctccgcgcgggcagcggtgagggcagcaacggtgtatccctagtgggagaccggtggaggaggcggctgatcgatgacaggaggcggaccgacaaccagcggaggggggtcggagggggagggtcctccggacctgcaaccccgcgggaactgcattcgccacagcagcaagggcagaggtggtgctcgcggcggtgagggccccaccggtggcgctaggccctgccccccactccggcccaagcgcaggggagagcgggggcgcgcgcgacgtagggggcggccctcccatcggcaacggcggcggtggctccagtgcccacgcgttcgggagaaccgtcacagggtggagcagcggcggcggcgcgggcccaagaggaggagaggggagggaagacgtggaagtaggagggggaaggaggaggtggttgctcgtcagccatggggggacggggtcgcgggcagggcgtctggcggcgcggtggcgcggcgggcgcgagctggaggcgttggcgcgagctggaggcgttggcgacgcggctcagccggctcagggtcgcgggcagggcgcctggcggcgtggcgacgggcggtagagaggcagcggcgcctggagggcagggaaggaaaccctagccggcggcggctgtggggtgagggaggagcgaaaccctaatctgataccatgttagggtaataatcattggattatcagggccaaccctagagggtggctatatagagtttatacatgggccacatgggcttagcctcatgggcctggcggcgtggtggcgggcggtagagaggcggcggcgcctggagggcagggaaggaaaccctagccggcggcggctgtggggtgagggaggagcgaaaccctaatctgataccatgttagggtaataatcattggattatcagggccaaccctagagggtggctatatagagtttgtacatgggccacatgggcttagcctcatgggcctaatccatatactctaacaccaagactttgcacctgcgttattggggctggttcctagacgtctggttgattccttgaaggtccaagatgctctcccaggttttcagtggatggcaagcttgagaggtgcactttctgtaagagttattgctgagtttcttgacctttgtgaagctttagaaggtatggtgctacaaccgggggttcaagaccaacatatctggaagtttgccggtttcaggttccttctcaaattcagcttatatggctctctttcaagttctgtggagtttggatcggctgatagggtatggaagtcatgggctcctagaaagtgcatcaacatcaacatagctttttagtcccaagcaagttgggggtaggctagagttgaaacccaacaagatgtcaccaaaaggagaaagagagagaaaggggaggggaaaagcttttgagagcactaaaaggaaaaaggcctaatcacggttcaggcacgtggatagcttctttccaagcacttctatccaaacacaactccatggggatattccattccttcaagtcccttttgattgcctcctcccatgtcaagtttggtcgacctctacctcacattattgtcccgtcttatgacgcctctatgcatcggtgcctctgggggtttagggttaatttttcatttaattagttcagcatgacaaatgttggataactgatagacttgccaagcgaggtctcgaccattcggagaggtgcttgctgtgtgatcaagcagctgaatcaatcaatcatttgctagttggatgcatatttgccaaacagttttggtttgaattattgaagattggatgctggcaaggcctttgtcttctttcgagtcatggtggatgagttacaattccagagtggttgaggcggcggcaaggaaagacttcaactctttggttattttaggagcttggattatctggaagcataggaacaggtgtgtgttcgatggctgcagctcgagtctggttgcggcctttcaggctgctaaggaggaggctatcctttggactctatctgagatcaaagctttgtctttccttcggattgatgagctccgagtctagctgtgtggtagagttttaggcctagctagtgctgagttgtctgtagaatccttctccgatgtgtgtgtgtgtttttgtattctaaattctggcctccgtgaggaggttttcttgtacttggtccattttggacctctattttctcctgcttaatattattgatgcgcagttctcctgcgtattccaggaaaaaagatttggatcagaagtatgatttttcgtgttgatcaagttgtactgaacaaacgtatttgtgcggtcttgcacaggatgatttttagtaagtgtttttgttggtaagattgtttcttgagttaaaagggcatgaatctaacggtcagcacctacaggtgttgatgtgggtgtattatatgagtctttaccctcctcctcttcttaatataaaagatacgcaactcttctgtattaggctatggccagtagatcgtgtatatggccgtataaaacattgttttacactatatgctgcactgtttatatagtggagtttgaaataagagatgatgggtatgatattagagatagctttagagaaagaaaaaaattatccctagcgcttcattacttcttttaccaaacaattatatatactccataaaggagcagtaatgagccttttcactgagccaaaaatattgtgttcgacgtagcatctatataaaatgcacggataaggtttgtctcgattatttctttcctagaccccgctcatacgatagccgctaacaatggatctatcctttatataaatgcaccattcacacaataaattcaaatgtgatgaaacaagatgaaggccaagtcagctaatgtgtattagcattttagatgccatatgtaaccggagcacatgatggcaaggtgttttgtagtgaagagaaacatatagaaggcgcaacaagaatataactatatttgcatagattgaaagttaaattaatcaagtttagttaacttgtattggaattgtccattcatttgcaactttcaattcttagaataattactaaaaaggtaaaccggttgaagtatgcaataaaaaacattgttgcacaaaatatgttatgattgtttagtgcaccaaatccctcctgtctctaatagtctaatacatgacgtttgggcaaaattagtacaacgttaagacaaccaaattagtcaaatttgtactaattttgttctaacatcatcatttattagtaaccagaaagaattgcaattttagccggccatacatggtgtatattggacttttgaaaccacaaagcctacaatgtgatttttggataataaacttcactgctagccacatttctaatacaattaataaatttagcaacttgatatgtttttgacatttaagcctgtcagacctcctgaatattttgattgagcgtccaaaaaaaattttgtggaacactgctcttcctcctcccatccccaatcatcttccccacatatactcatatgtcgtatcaactaactggcctcaatactactgttgttaacttggttgccagaaactaaagctatctttgaaaacgacattaactattaatacaggttgtgggtcaaaaactctactacagactttaggtctatttctagtaaaatcaatacatgatggtaacagtgttatcaagtcatccaactaatagcgatcagtcgggataatgggtgccatggtgattgccaattagtcggactgattagtgacatgacggctaggatcgattagacgatttaacaacattagatggtaaggctgtataacccataaattaacagaatttttctattgagaatattggtgtggatttttctggaatgtggaaaacatacagcactctctctacaccacacacacttctagtatatgtgtacacgttaatgggccaacactagacacatggtccaacactccccctcaagatgggcgatagatatcaatcatccccatcttgctacataacacatcacactcttttactcctatacccttagtcaagcaatctgctatttgaccttttgagtttacatgattcaactctaaagtaccattatctaacttctctttgatgaagaatcgatcaatttccacatgttttgttctatcatgttgaactggattgttagctatattcatggctgacttattatcacaccataacttcagggagtcttttcttaatacattcaactctgataagagaccctttatccatagcatctcacatatcgcaagggccatagctcggtattctgcttcggcggtggaacgggataccacagattgtttcttgcttctccatgatactaaatttcctccaacaaacacacaatatcctgaagttgaccttctatcatcaaggcaactaccccagtctgcatcagagtaaccttccacctttagatgaccatgacctttaaagattattccctttccaggacaagtcttcaagtatcgcagtatacgatacactgcatcaagatgtccacttctggggtcatgcatatatcgactcaccacactgactgcatatgtgatatcaggtcttgtatggcacaagtagatgagccgtccaacaagtctttgatacctttctttattcacaggatcaccagattcagcacataatttatgattcaagtcgataggtgttgctacaggccgacaccccaacatacctgtttcatcaagtagatctaaaacatatttcctttgggagagaactattccttttggagatcgagcaatctcaataccaagaaagtatttgagatgaccaagatctttaacctcaaattccttacttagattcttctttagacatgcaatctcaagatcggcatcacctgtaataataatatcatccacatacacagctagaattgcaattcgtcgtccaaagtgttgataaaaaacagtgtgatctccgttgcattgtttatatcccatgctacatattgcacgtctaaatctgtcaaaccatgctcttggggactgcttgagaccatacaatgattttttcaatcgacaaactttcccaattgtctcaggctttgacaatccaggagggatctccatatagacctcctcttgcaaatcaccatgtaagaaagcattcttaacatctagttgatacaagggccatccaaaatttgcagcacaagagatcaatgtccttacagtactcatttttgccactggtgcaaatgtctcatcataatcaattccatatgtttgactataccctcttgcaaccaatcttgctttatatcgttctacccttccttctgggttttgcttcacagtgaatacccatttacaactaactgccttctttcctttaggtagtttctcaaattcccaagtttgatttttttctagagctttaagctcctccaacattgcctcacgccagttagaattacattgtgcttctttccaatctcttggaattgctacggaatgcaatgatgcaacaaatgctctatatgatggtgacaaagacgcatatgagacataattgctaatgtcatgttcatatccataccttgttggggggactccagctttagcacgcgctccttttcgtattgcaatgggcaaatcataagtgtcataatcttcagtttctccatgagacgtcaaaggtacatttatagcctctaatgtgtttggagagaactgctcagtacttgatgctgaattggtttcaggagcctgaggttgcacatgggactttcttcttgtatatacttcgcccttatatcgtaagtcgtctccacaagatttattattctcgtgactaggatgtgtctccaattcacttggcattacttgcatcttttgagaagcaccaatcaccacttccattttatttggttgttgttccattgaatcaaccattctgttctccccctctcgactagcttcatctgtgctagtagagacagaatcaagaaaaaaatttagatctgtcttctcaccatagaaaggcacagtctctctaaatgtaacatccatgcttacaaacaaacgtcgttcactaggactccaacacttgtatcccttttgccctgcaggatatccaacaaaaatgcacttcacagcacgaggatccaacttccccacctgaggtctatgatctctgacaaaacatgtacatccaaaaattttaggtggaaccacaaacttattctcaccgagaagaatctcacatggagtcttcattgcaagtatttttgaaggagtgcgattaataagatatgtggcagtcaatacagcttcactccataggaacttcggaacattcattgtaaacatcagcgaacgagcaacttccaaaatgtgacgattcttcctttcagccacaccattttgtggaggtgtatcaggacaggatgtctgatgtaatataccatttcttgacagaaatgcattaaatcccttgtttacatactcggttccattgtctgttcttaggattttgacttgagtattgaattgattctcaactagtgcacaaaaattttgaaaacacttcaatacttcatctttatgcttcatcacatagacccaagtcatccgagaaaaacaatcgataaaagtaacaaagtacttcatcccattaatagaagtcacaggacatgtccaaacatcagaatgaactagcacaaaaggagatatactcctgatacctcgactaatataagatgtccttgtgtgttttgcaaactcacaggcatcacacaatagcttgcttttatccaccccactcattacatcaggaaaagctttgcatatcttatcaaaagaaagatgccctaatctacaatgcaagagcatcactgcaacctccttctcttccattcttgttgccagcatagtgcatattgtaccattagtcccctcatgatccatataccacaatccattacgcctggtagctgtcccaagtctcttccctgtttccctctcctgaattaaacaattatctcgatcaagaataatacgacaatccaattgatcaaccaaggcacttagtgatatcaagttgacaggaaaggttggcacatacaaaactgatgacaacttaatagatggagtgcattgcactgtgccaacacccttgatgggttgtggtgtaccatcagcagtttgtataatttctttacgtgtggggggatatcttatatatgatgtaaattcactggacgtgcctgtgacatgctttgatgctcctgagtctaaaatccattttaactgtgtgacctgtgtgggtacaaaagcatgagcataattaccttcatcagtgtaggcgaagtggacaaaatcccctgtgtgagactcctgatctttatctccagagatttgatttttcttcctcaactttgtttcatcttcgtgttccataaatgtttcaagttcttcttgtgtagttgctgcattcgcccttgcccaactcctgcctccacgacctctgccgcctctaggagcccctcttcctctcccacgattaactttggaaggcttagaacaattacgtgcaatatgtccaacattaccacaattgtaacattctctagtatctttggttctcatagctgaaaacacaggatgaggcggcgtttgagaactttctctcatcactttgagtcttgactcctcctgggatatggcagctatggcttcttgtaggctaggaagagtggattgatgaaacatggaggcacgtcttccctcgaactctgagtttagcccccttagcaattgaagtacacgtcttttttccacccatttcttcgcccaagcaacacactctgagtgtggtagctcaataggatcataatgatcaacatcagcccataaacattgtaactcctgaacgtactccgccacagatcgctccccctgtttgatattatggaggcgatcttcagtctccaccatcaacataacatttccagctcccgagtacatttcttcaagtgctttccacatttctgcagcacttatgattgtatcaacagtgctagcaattgctggaatcatagaactcaacatccacgctgccactaaagagtttatagcatcccagtctttccattcatcacttaacttatccttgggctcaacgacatctcctttaacatagccctcgagtctctttgccttcaataatcgcaatgctcttctagaccatgccaaataatttttcaccccttctaacttaatctcatttggcattaggtctatcttctgaactggttctatatgagcaacattgtctttaattgatgatggagcctcatccctttttgctgacagtaattcgaccaatttaccaagaacctgctcaattccttgattttcccccataatatatatgtaataataactaggaaactacttgggcagctgcgtcaagatctgggtcacaacgtctagaagccaggaccaggagcgcctcctcttcctcctcctccgagctggatggatctcagtcacaggacgcgggcagcaggggggagcagcagcacctgtgtgccggcagcttcctcaagggttggacgagctgcggcagctggagagcctccccaagcacccctatctccagatccttgtcgccgacgagtgcccgcgtccacgtccttggccgccctcgccttgtcggcggtggcgtccctcctgtgctgtggctcgggacctgtccctggcctcctgcgcggcctccctgctggcgtcggtgtactcgcccgtcttctgcctggtcacgtccctcgcctccctcgatcgctcgtgtgcctcggcggcctccttcggccgtcgctgatctccttctcggtggtcttctccgtcgaggccgaagacactcgtcaccgcgacgccatcgccgttgagcctggctccggtaccatgtggatttttctggaatgtggaaaacatacagcactctctctacaccacacacacttctagtatatgtgtacacgttaatgggccaacactagacacatggcccaacaattggacatcccaaaatgtcattcatgaggtgtatcaggcagtccaaagaatatcctagtattattttgttcatattacgaaagagcctctagcgtaatggttaaggctttcgagtagcacctttaggtcccgggttcgatcacctcggatgcgaatttcgggtttagttaaaaaaacttattgtgccccacccgctcccaggttacgtcctgcacgccacccttcggttggaccattgtagggtggacggtgacagcctgctagtgatgggggccaatgttcggagatttttcttggatgagactatgtttcggtctcttattaatataataccaggagggtggtctttctctccatggccgagttttttattttgttcatattgtaatgtttgaggtgaaagcaatttaatggtttgtaaaagtagggattgtatcaggggcgaagctactatgtagccagtgggtgcaaatgcaccccctaaaattttaaaagtcagttatagtgttcaatttttcaccatatatgcatcactcacatctcatccttatgcatccacaagagaggtgcaccccttcatgtttgctctagcttcgccactggattgtatgtttgatatgcgcttggtattaagagaaaaaagaatacaaccatctgattacagaatctgcaatacctcaaaagttgaggccagagtaggatgcaaatagaacaaataaccaatcactgatgggaaaggaaaaacatgagcaagacaacatcctatgcaaaagcttatctaagacctagaccagtgagacctctggcatcagccatgcgccagaggtgagtttcccccatgagacccctttgagcatcctggattaatatgcactgaccatgtcaaatagttgtgattgacctctggccagtgtaaattggcataccccaaaatatggaaggggggaatggcatgggttatttccaccatttgattcacttcaaaaatttcttctcttgtatgtttggtagaaatggcaatcgcaagacataagcgctgatacacggtcgacagttaaaagaaaacatgggtgtaaaacagaaactaagacaagatattgatatattagagtactctcatttataaagaagtattatatatctatattaacctacatgtttattcattaactgttttcatgtgcatctgtatggtcatcgagtcccaccggttctttttattgaggaacatgcatatatagaccctgaataccaataatatgtgataccagtgtgtaaaggagtttagggcagtttctagaagcactaataaatccaaacgtattatatgttgtcaaccgtttataataatccatggagctttgtcatattcttttactaaatatagcgctagtaatagttatgtaataaattcggtttcagattagtactccattccaaaattgtaagtcgttcaagcttttttagagatagcttttgctacacaccttgatatatgttatgtctagatatattgtaaaaactatgtatctagaaaagttagaacgacttacggtatgaaatggaaggagtacaaagaatactgtgctgcaaggcagtccatggttcacttaattatcctattatgttgagttccttttcatgatgttgacccatattaaataatgtaaatgttctttgctttgtgtagggcaattggtgccatgaatatagaaaactaaaggcgaaggtcgagacaatacagaaatgtcaaaagtaatttgtagtgattagttgctgaaaatatgtaatatgccctgttgaagataaatatgaccaagccttgtgtgtcctgcaggcacctcatgggagaggatcttgaaactttgaatctcaaagagcttcagcaactagagcagcagctggagagttcactgaaacatatcagaacaaggaaggtagtatgatctatatattagactgcagtgcattacttacgtgatgcctactacaccactgacagccatgcgctctgcatgttggaaaactaacaagtaaatattcaccgcatgcgcagagccagcttatggtcgagtcaatttcagcgctccaacggaaggtaaattgttgagcttgctaaagttggctgttcgaacttcctcttttaagaattgtatgatttctttagctggccattagatgggcatggtttattgcaagtgttaactactttggttgccttgttacatccacaaaatatctctgctcttgcgctgtgctgcgatgcattgttaccgcaggagaagtcactgcaggaggagaacaaggttctgcagaaggaggtaggcagacgctgctgcaactcaacgtcgcctcatccatgctcaactggccctctgttttctcatgaaccaaatcaaatttacagaaagcgttactcctgcatgcagctcgcggagaagcagaaagaccagcggcagcaagtgcaacgggaccaaactcaacagcagaccagttcgtcttccacgtccttcatgttaagggaagctgccccaacaacaaatgtcaggtagataacagattacattcacatcgtgctacaatcccaaatagtgatgtgacctcattttcgggtaaagatttgagtgtgcttgggcttagctgaatcccatttcaaaaatacacttgtgcattttcaaaatatactcttgtagaccagcatgagcaatgttggcagttgacccacaatgttccttcaaaaaaacttggatcgttaaagagccacaaagaaaaagaaaaaaaaatcttcaggaaatgataggttagtttttttcttcacataaggtatgtggtcatttttttctacaaattttcgtgtcatccctctagatgtacgggtttttttttgagcttgcggtttttatcttgtaaatttccaaaacagtagccgcacgcctgtgctcagccaggtaaatttcctgcagacgcactgctgacatgtcaggaagcaactggctgaaaaatgaccgtttgtgtccggtttttgcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctggggcggccgcacggtactttacgcatgtaatatatgtgcttcatcaaatcactttcactaccatagcatgtgccggtttgtggtagtttcatgtctcacataatgggtacacattcatatcccagtggtctcggttcttcacatcaaagttctatttcttcatgcagcaacttctatatcttcatggccgttcaaaaatacgtacagattaaagatgcagctgcatatgtaacatcaatagagaaagggctacatctgatttaattgcgatgttctgatgtctcctagacaccttttagtacaaaatgcagatgtatgaaaaccagaggacgacaccgtggtattctgtcgaataaactaataaagatggtcttaaaaaatgatctttctgccatcggtgatgtacaaccatttcgccatcacaaatcgaagtggttaccatcccatgtcatagctgacacgaatgcctacccaacccaacccccaacacacacacacacacacaaaaacacatttaacaagctaaagccctagttacttgtaaataacgccaataaacatcctctgaattctgtaccttgaccctacaggtgaatggaggatgcgccaaggcatgtggaaaaaagagtgggatggctattaggatagccgaggtagcttctccttcagccgcgaaatgaacttaaatgtctcctctgcttttacttgttgataaatatcattccttgataccctgtcgggatggaatttcagaagagcttgcttgaaggctttaacctgaaaaagataagtaatgtcatcaaattaactactccctctatctcaaattagtatttgttttaactcttggttttatgtctatattcatatggatgaagatgaatctagacacatacaaaactcctaaaacgaattttaatttgggacagaggagtattatgttacaggcattcctaaatctcttctatgtgccgagcagaaagcttataaattagtctctggaaaaaaaattgagttcattgaaccagaacacgggtttataaggtacaggtagccactgatcttcactacccaaaagttgagttcattgaataaatttagcccaacaatctgttgcactacccaatttgttcttcatggt

SEQ ID NO: 504 - protein, 245 aa, Zea mays
MGRGKVQLKRIENKINRQVTFSKRRSGLLKKAHEISVLCDAEVALIIFSTKGKLYEYSTDSCMDKILERYERYSYAEKVLISAEYETQGNWCHEYRKLKAKVETIQKCQKHLMGEDLETLNLKELQQLEQQLESSLKHIRTRKSQLMVESISALQRKEKSLQEENKVLQKELAEKQKDQRQQVQRDQTQQQTSSSSTSFMLREAAPTTNVSIFPVAAGGRVVEGAAAQPQARVGLPPWMLSHLSC

SEQ ID NO: 505 - DNA, 21285 bp, Zea mays
ctcgaggatcatactaggacatgagttcctcccacaaaatgacatcttcacgcggcgggacaattcctgcactcccaatgcatgcaatcaatagatcctagcatacatgagttcctcccacacaaaaaagtagttgatggtagctgaaaagaaatatatattttatatgtatagtcgatagtggaagataggagaatgtttagaggagccgttacagaaggagtgaatatagaaaggaaatcttgataatgtggctgcataataagatatatagtagaaatttagggttgagaacagtcttaatgacgcactcccttctgcaaataggcagacagtgcgtgcgcacccgaccaatggcggctggggtaggagaatgtttagaggagccgttacagaaggagtgaatatagaaaggaaatcttgataatgtggctgcataataagatatatagtagaaatttagggttgagaacagtcttaatgacacactcccttttgcaaataggcagacagtgcgtgcgcacccgaccaatggcggctggggtcgatattttttcatcggatgggaaattccaggcttcactttcctccctccccaaccaaccacccccggccacccctgacccctcccgcgctcttttcttttactctccctatttttttaggtggtggttcgtctccgccccgtccagcaccgcccgcagccggaaacggcacccctaccgaatccgccctcctctttccgttcgttccgcctcgtcgctctcgctctcgctgcaccgcccggccccagcctgccttgttcacggcaacaccggcagggacggaaaaggaaagcccaggtgtgcaaggcaggcacacatagccacaggccacggcacaggcagcgcggcgctggctacggccaaaaaccctacgcggcccctcggcccagctgcttccccctccctcttctctctcccaccaaccaacgccctttcccttgccatttttggtgagtgcgccctttcccttcctccccagatccccgtccccgttttccacttttgcctccgccccaattcggataacaaacccctccgcctcgtcgcgtctcctcccagccgagccgatccggtagagagagggagagggagggactgagggaggaggagctgggttccggtcccggccgcccggccggctgcgcgattcgattgcagctctcgtccccgggcggcgtccaggatggtgcggggcaagacgcagatgaagcggatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaaggtaccaccaatccccttcccccaacccgtcttcccttcgagttcgagaatacctcgttttttatggtctttctttaggccttagctatccttttttttgcatgggggtattcctgggagtataatccttggctgcgggtgtgtcgattggtaaatgagctgattcgagactcggattacttcattgttctccgttgggggctgatatgggagtaattcttgcgcgctccctgcgcaaagccctgcagcaaccgcgtggcctcgcctctctcgtccttttgagtttttggggacgaacacatctcttccggtgaatataaaagataccacgcaccccactccctcccttctccccctctcccgtgaacagatcggtttgaagattttgcgccccgaagatctttacatcaactttaccgtggtttcaggcggaaaggacagttagtacatgtacgcagttcatttctcctataaaaaaaactagtgcagccgtcgagccaataggaaaattcgacctgataacatggcaaaatatatgttcacgtacggcgatctacggatcaggcaggctacgacctacgagtggtcacgctaaatgcactgcagaaggttgttcagctatcttttctttagtgattccttcaaattctttctttgtgtcagctaaatccgttttaagttaaacccgttttatttaaaccatggagcgatctggaggtccgtttctacttctgcatcggtcttctttgtagtacggctggcaccatctgaggaagttcttgttttgctgttcagacacaaaaaccgatgcatgcgatattgtgtactatgccttccactgtgcatatattgtttttattttttcggcttttattgccacatagttaacacaaagaagggatttctcactcttaccacacactgcggcgccctttataaagctactgctgactgcagttaatctcatccacgtttcattagattttggggctcacccccgtttcttgcgtgccttgtgcaagtaaagaaatggattctaaacacggctaccatctctaacagagatgaatgaatgacataagaaatcacatgcaaatatgacgagaagcactgtaggttacccatcactccttgagatacatctttagctgtggttttgccaagtaaactgtcactgaaaataggtgatttctagggatggttttattaagtacacccttcctagaaatcaattttcaaggccagttgactaagtcaaccacccttaaaatagccacagtacaaatagattcattttttccaaatagattgagtttatatcaaaattgtagagttcaataagatctaaaactttgtggttgatagttttttttatttgaggttgctctatgtcaaagttgcaattctcgatgagatctaaaagtttctaagattcttacaaagaacagtatcatatgtatagtcatgggtgacagtctgtgtgttggtaggaggtggtatgcatgagttctagttccctgcggctgcacttgtgcaaaacaagcaggccaaaataagtttttcttgttttttgtaacttctacatggttttttttaaaagccaaaaaaacattttttaatggtggttgtcttgagggaactaacctcctattaaaattaacttctaggaatggtttcaaaactgcccattaaaatgatttcttttaattttacgatagatagcatcgcagcagtatttcaagataaaaactcggccgagagggaaagactgccctcccagtattatattaagaagagaccgaaacatagtcctggccgagaaaatccccgaactctggcccctatcactagcgggccgtcaccgcccattctgcaacgacccatccgaagggtagcgcgcaggacgtaacccgggagtgggcggggcacaacgaggggacttttttttaatcaagccagaaattcgcccccgagggggatcaaacctaggacctggaggtgctactcgaaagccttaaacaagatcgttttcaccgttagcaaaaactatgtctgtactagtggtgatggcttcatagatttggtttatgtgctagatctattatagtaatacaacctgttgatttttttgcaacatagttaacctagaagttaattttgtattcaaaccacattgtggccttcgtcagtttgatggccagtggtgctctcttgtttaccgctggccgtagtttcatcaacgtttcattagatttgggcctcacccatcttctcttgccttgtgatggcttcatagatttggttatgtgctggatctacaagtaatatagtctgttgttttccccacatagttaaaccaaaaaggaatcttctactcagatcacattgtgacctttgttaggacgatgatagtggtgctttcttgtttactgctggctgtagtttcatccacccatctatctgccttgtgatggtttaagagatgtggttatgatctactagtagaataaggtcttatttggaacctttatagctaatagttacctgctaaagttagatatagaggtttcaaacacacctacctaataccccagctaattgttagctaagtaatagttaataattagttcattagctggtttaacccagctaataatttgttagctggctaactactagctttaggggttccaacttccaaataggacctaaactgtttgcatagttaagttttctgccctaagcccctaacagcccagaccatggtgcaaaaaaaaaaatatatagttgatgcccagtagggttcaagcatgttaagcctttggaaacctaggggactagacacagaaaataaatatacttgtttcggattataattgttgagagaattgtgtcatgctaccatagccaaattgatctaacttccattcatactgctcagctttctgttaaggtgataccaaggactgattcatttcttttagatgcgattaagttaccagatataatcgagataaacaattcaatgagtataatttcaaataaagaaaaatgtagtgacaatgtttgaaattttgaggtatactgttttattgacctagacacttgatgaccatccaaatggagaaaatatttgaactataagttgaattctaagataagaaattgggtctttcaaagacctgttttcaaaatcatagtttcttaatttgctttatttattcattcatgtgtagcaagaaacaaattctttaaatctggtatttctataattgctctcttatagcaagctttcccaactcatagttagctttgcaaaaaatgctctctacataattagtgttgtcaacgatgttacaattgattgttctcttaaattgctcttacttaaatatcatggtgcctaacctatgttttagttagacatttatctatctatttaaaatatgtcaataacttaatcctaattatgagatcaatattaaaaataggttgtaggacaaatatatatttacttctagccatgtgataatatcaatatatcattgtatagtccacttcatctccccatgtgacatacaaatacattggcatgttaagtaagtcacaaatgtaatcatgagacctatgactaccatcacataagtcctattagtacaatgcatgtgcgttacaacggtacatcaatcatgtttggtggtatagtgcaactgttgtacaacactcgagagtctagtggcaacacagtgtgatggaccctccaaaataaatttaaaaataaagtagaccttcccaaaaaaaaaaaattaaagtggacatatggtccatatacccgatattttttttctctcgaaaaacgcaggtgagctgcgcatctttatattaagaagaagggaaattaaggtccaagaggaccagtacaaaaaaccaccctatggtggccagcaagaagcataaataaaactgtccataggacaaagatacaaagagacgaccaatgaaaaattaagtcgagcttgttgcgcctagagcagcagcaagatcaaggcttccgaggtgtttggcaccagccaacacccataacgatagctcatcgatgaagcttctatgcaccttgtcaatggttgtcgaatcttcatcgaagataattctgtttctatgcaaccaaaggcaccatgctcccaaaataatggcactgttgactccctttctataatttctgtgcacctgaaaggtcacttttccccaccaatcagcaaaaatagtatcctgtggccctggagttaggtggcccataccaaagggggagagaatgctatgccaaaactgtctggcgaagacacaactagtcaacagatgctgaactgtttcttgctcttgttcacagaaagggcatgcttccggatgggaagacctcttttttgtagcctgtcatctgtccaacacttattctgcatggctaaccataaaaatgtcttacacttaggaggagcccgagatttccaaagtcttttctaaggttcgaaggtgatggagcctactagatattgaactgtagatactgcactctatctcagcaaaaagattgagaaaggtatgagttaaaaaggagatttgtcccttttatagctcgctcgtcgtccttcatctagagaagtggtactatccgggagagttgcgctacctgtggctttgtgtcatgttgggcttggtattttctcacgtcccatctaaggtgtaaaggtggttgttaggcgagacatgggggagaaaaacatgtctactctacatgtttcgcgtttgacgcacgacacatgaaacttgtgctttaaaggagtattttatgtgattgttgcactccaccacaaagaatccactttttaagtgatttcaaagaggtttaggtttggttactaaaatttatgcttgaatatagagtataaaacacaaagacacatgttctttgttggctaggcgggtgtgaatgtgagtttagaaccaacaaccatggtttgaatcctcaaccatataaccgtggacactggtgctttatacagtagagaaaaaattgccactgggcccatccaacagccacccgctcttcatgtcccacatgctggtacctttttccttttttttaaaaaatatccgtgtgttgtgacagtatactaatcaagtttgatagtataatacaacagttgtacgacactcaagggtccaatggcaagccagtgtgatgaaccctccctgcaaaaattaaatttaaaattaaagtataccctccccaaaaaattaaaattaaagtcgacatttgttctatgtaccagaaattaaattgtagatattgtactttatcttatccaaaagaacgagaaagatatgtgttgcaaatgagacatatcccttttcatagctcgctcggtcgtttgtccttcttcagctagtcaggtggtactataagagagtgttgcattgcgtgtagcttcgtgtcatattgtgcttgcgtgtttctcacggtccatctaggaggtaacaacttggttgttaggatgtgcaggagaaaaaacacaagtgcgtgacgtacaacacatgaaactcgtgctttaaaggagtagagtagataatagtggattgtttaatgtatcaactactttgcttgatcctaatataaaaaaggatgaaacataattctaatttatatgatgtttcatccttttttaactaatcttaataattatttttaaacagttccataacttatttctatcataaaaaatatcttctatatttaagcaataaagacccgcacgtgtcggatatagaaaggatatcactaaactgcatgaatacaaatgtgagccaaaaaatgagtggggggggggaggggcgatttgcatgtaatcattactcgattgttgtaatgtcttggttttaaatgtagaaacatcaaaatttgatccaacaacaaaaatattatttaggtatatgcttatatgttacaaggaaggccaatgtaaatgctagtaaccttaaaggaaatactagagaaacattgtcatactccaatcattgttctattgataatttttcaaagttacaacatgatttcacatcttgaaggctaatcaaccattttaggtgtatgtgctccctaagagacaaactatgagctaactctccaaattaccatttgtaatggttttttgtcagtagaccatgacttgctagatctcttgaacttttttggacccacatatcaagcgctcttgactaaatgacgtcctcttagaataacacatttggccatctccttggctaggggagtgctgaatgaattacttgtatacaaagtattttgcatgctcttgattctcaaggcaaaagatgtatattttcactttgttatgaatagcacttgtattaaatatgaggtcctaatgctaatatatatacacatgtacaacatagagtcctatccatataacatagagaaatagagtcacaataggaaaacagagtcctatctaacaccctctcaaactcaaggtggatcaaccacaccgggtttggacatagagtcgatgctaagctctagtctacgccttggtgaagaaatcactcaactaaagcactaaagacacatagtgaagatcaataatatcatcatgaacatgtggtcatgtataataagtatcaacaccaatatgcttactaagctcatgctttactagataacgagcaatactaataacacatgtactgtcacaccaaaggggagttagtatagacgtagaaacaccaaaataagtaagcaaccattgtagttaagtcacctttattgtcacaagagccatagcacgcaactcatcatctgtacttgaacggtaaactactaactgcttcttagtgttccaagcaatgagggatccaccaagaacaacacaatagatagaaagagatcgacgatctgaggaatcactagcccaagtcgcatcatagtagacatggagctgcaagcagctagagcgaggaaagaatagacgacaagagatagtcccatgaagataacgtcgaacaccaagaatatgactataatgaagttgagtgggcgtagaaacaaactgacttataatatacacatggtacgaaatatcatggtgagttacaccaagatagaccagaatacctacaatgtgatgatagcgagtaggatctgaaagaggctcaccatcaatgacatgaagacaaatgttgagctctatgggagtgtaaacagtgcggtgatcagtaagggaagcctgatcaagaagcccatgaatgtatttctcaggagaaagggatagaaaccctccagagtagaggaaacctcaatcttaagaagaaatcgaagaggaccaaggtcaaagataagaatctactcacttaagaagtgccttcacaaaggtaataaattgagtcatccactgtaaaaaccatgtcatcaacataaagcataagagtcctaccatgagatgacatgtgcaccaacaaagcaggatcatgaatattggtagagaaactagtagaagtgaccacagaagcgaaacacacgcgaagacaaagattagaccctcacaaaagccgtgcctgaggactagggaaacctcaagccgcgcctgcctgagcgctgccgtgcgagcgcctgggtgccttcttcgaaagaacgacgacagatgcaacaacgaggaagctcgtctcgatggtggttgtcgatgtagggttcgggcgagccacacctgcgttcgatttgggggcgagatgggttgtagtgcatggaccttgagacatgttccctagagccttatacatgtatttgagtatttatgttcatgaaattttcttagcgatatgttttactatataattaattaataattttcatggtttctacaaaacctttgaatgaataggttatgttaattccaatatagctttctatagcttcaggtgaatgtttgtagacctttatttttttatgatactttttgaagatattatgcaccattagatcatttctccatagagggcacggtcgaatttgaacaaagtaacaaaatcacaaatttttaagcccatgtcaacattcatgacaagcttaccaactactaagatttcttagaaagaacatagcacaagttgatctattacaaccacaactaaaataaggttaagaaacgatacagaccacacaatatatctcacaaaacgtcgaatgtctaacaacgattacaaaaccaagaccaaagtacacatatataaaggaacgatgtttttctagttttgaagacaaagaacaagatagtttaccaccaagccatctaacacgatcgatgctgtcttttgatcatgttcttcatggcgatggtaatgcaatgtggtctcttctaatgcccctcatcttcattctttaggaactttggttcttccaacctaatacaatggaaaagaacaatgccaaaaaaaaagaatttcagttggatatttaacccttaattttttaaaacaaccattcatttagataaatacaactatgtggattttttttctattttattaatgtttgccttaatccataagatcaaaagtctaggatacatatggcactaaacatgtgttaggcaacaaccaaactccatgctaattctatcataataacttgttctacaatattttttgtatgaaaagacaacctcattactcgattatcctctctcagtcatgttagaatagcatttaaaaatcacatgaaaatcttgattttaagaggtatcctagattcccatttttcttatgtcacaccattatcattactatattggtggttgtacttcaacttaagagagaaaattatgcatttctacaaattcattttggtttatcaagccaatttttgtagcttgaaaatgtattagcactcgtgccaaggatgatcaatgacaatccaataggtataagtgtttatacccaatgttttgaactaatgtattagcaaggagtcagggtttctcacttcctttgttgggtcaagccaagaaatttaggtatggcacgagccatagcgggtcataatgggcctccaccactgtcatcctacaacactactctcttgacgatcacgtcctcattgatgttgttcgcctgacgatcccgtctttgcacgggtgaacaatgtactcttctagatccttagcacaatcatagtcgagttgcaggacatcgtccacaattgtgacaatgctactcactaggcctaggttgctatcgaggaacagttccttggcaaccatgaggtcggtgccctccacctaaatattggcttccgtaacttcgtttaaggggacctctccatcactaagtactgccacctaatgatgggcatggtggacttcctacatgacctcagcgagcctattttggattgtaccccatccttaatctcctttgcggcctcaatgagctacaatcacctatagacttggatcacacgatccatgtcgttttttcattccacactgtttgcaactatctcatccttgaggagctcaccaaggggggccatgtccccctccgacaccgccatggccttcgacaactccacctctagtaagcaaccatagtgctccactcctactattagtggtctgtccttgtgcttgcatgcaccatcaacgtcaacaaccccttgtccccctaacaactctggtggtggtagcctcggtagcagagggatggccacggtggtggtagtaggaagggtgacgcaccctagctatcactctataacccatggaccgacacatttctttatggctcgacccaacgatggttggttcgtcgccatgcccatcgcaattgcagtcaatcctcctcattatgcccacctttggtagcctcgagtgcctcctagatctcccctcgcaaggatacccacttcagggccaagctgtttgtcgggtaactccgtagatacccttgatactttcccatgtgcaagtggatctttagaatagcctctcctagaccgctcctcgacgtcttcactattgagtttttttttccaaaatatcatgggcctcgttatctccagtacatgaaggtagccataccataaagacaattggtgtgatctcgcaatactagaagcataacgttgagctccacaggagtgtcaacaatgtgatgatcattaagagaagtacggtcaagaagcccatgaatatatttctcctaaggaaggtagaagccctccggagtggacaaaacctcaatcctaagaaaataccgaagaggaccaagattagacataagaaattagtcactaagacatgccttcacaaaggtaataaattgagttattccctgtaataatcatgttatcaacataaagaagaatagtcctaccataagatgacatgtgcatgaacaaaataggatcatgagtactagcaaagaaaccagtaaccagtagtattgaccacagaagcgaaaactgaaatacgcacgaaatccgcgcctaaggaccacgcctgaggaccagccgaccaggaagtctctcctgctagactgagacttgatcagcaataccatgacccgcacacgaagaccgagactagacctgcacgaaagccacgcctgaggattatcctcaaccttttcttttttaataatataatttgttttctaaaatacatgtcatgtacgggaacacatatgccaggcgcaggagagcccacgacgtgcgccgggcggctgagtgagcagcaagggcgcaggagcagcagacaatcagctaggatggaaagtacctaactgattagtcatttccctattttggtttagctgggatggaaagtacctagctgattagtcatttccctattttgattagtcctacaatcaaggagaaccttctccattttgtaaggccaccggccatataaccctgtacggaggcaccttgaggggaagcaataatcattactgtccagccctctctctctctctctctaagccggcgactggaaggttcacccagtcgacgttgaagctcgacgtgggggcataaccctgccggcaaccatggaccaaggctacgagctacgtagctgaggtcctcctgccttaggcactaatgcccatgacagcctggtatcgcgaagccgacgatcctcgtcttcttctcaaccacccacatccaccccagcagccaccaatcagccctccccaccaccctcgccctcaacctccaccgcatcctcgggccacgctaccaacatgtccgacccaaccatggtcgacctcatggagctgatgagatcctggaaaacggagatcacgacggagatcagggagatgaaggacgagatggcctccataaaggcgaagtcggcctcgtcatctgacctgggaggcggcggttgcatggagcctcctcgtgagcaggatcggcgcccaggttccagacgttggactttccccgtttcaatggcaagtctgatctgaggctctttatcaacaaatgtgagtcatgttttcgtcaacagcgcaccatggccgaggagcgcgtttggatggcggcctacaacctcaaaggcatcgcacaagaatggttcatgcaactctaggaggacgacgacacgccgtcgtgggggcgattcaaagatctccttgatctgcgattcggaccggcgcggcgctcggtgcccctcttcgagctgacggagtgtcgacgcaccgacaccgtggaggagtactccaaccacttctagagtctcctctttcgcgctgggcggctcgacgaatcccaacgagtccagctgttcacagacagtctgcttccacctctcagccacgccgtccggctccacagtccggagacgctggccgcggctatgggagcctcgcccgacaagtggagttgatggaactcgacaagctggcggcggccctggccaagccggcgcatcgcgcgcccccgaccgccccgacacaacaccgggcgttggcagcaccacaggcgcccccgctgctcgcgctatcggcaccgccggcgaatgctgcaccagccgcgcgagagcggcaacctggttaccgtctatccaaggaagaacatgaggaacgccaccggctcgggctgtgtttcaactgtgatgaggcatacttccgcagccacaactgcacctgtcgccgcatcttctacgtcgaaggtgttgcgctagagacagacgacgatgtcataggcgctgctggtccagcgggggagccccccatctactccctacatgcagtggccggggtacctaccttcgacacgctgtgggttcgggcgctcctcgggacagcagagctagtcgccctcgacacgggatcgacgcacaacttcataggcgagcgcgcagcgtaccgctccgggctgcacatccagccgcgcccacggctcgccgccactgtggccaacaggcgagcgcatcatctgcccgggggtcatccgcgacgcgctaatcaaggtgcatggtgagacgttccacatcgaccttttcgtcatgcctttggcaggtttcaacctcgtcctcggcacgcagtggttgggtaccctcgggcccatcgtctgggacgtcgctgtgcggactatgcagttccagcgcgcgggacacgcagtctgctggaccggccttgcctcttctgataggccggccctctgcgcggccacggcgactccgacgtcgatgcagccccaactgggccgggaggccctcctcgacgcccttctttactccctcggcaacgtcttcaccgagccccgcggcctcccacccaagtgtacccgtgaccactgcatcaccctcaagccgggagcgctgccgatggcggcccgtccgtaccggtacccgacagcacacaaggacgagctcgagcggcagtgcaccgccatgatcgagcagggcattgtccgccgcagcgactcgacgttctcctcaccggtactcctcattaagaagccggacggctcctggcatttctgcgtcgactatagggcgctgaacgcgctcaccgtcaaggacgccttcccaatcctggtggtggacgagcggctggacgagctccacggcgcgaaattcttcaccaagctcgacatgcgatcgggctaccaccaggtccggatgcgcccggaggacatccacatgacggccttccgcacccacgacggcctatacgagttcctggtgatgccgttcgggctgtgcacgcctcggtgacgttccaggctttgatgaatgatgtgctgcgaccgtttctttgccggtttgttctggtcttcttgacgacattttgatctacagtaagagctggggagaacaccttcgtcacatccgcgccgtcctcgaagaacttcagcgccatcagctgttcctcaagcgcaccaagtgtgtgttcggcgcaacgttgatcggctacctcggccacgtcatctccgaggcgggcgtcgccatggacccggctaaggtctaggctatccgggactggcccacgcctcgatcagcatgggcggtacgaggcttcctcggcctggcgggctactaccggaagttcgtccaccactaccgtaccgtagccacgccattaacaaccttgttgaagaaggacgggttctcgtggagcgagaaagtcgcagcggcatttgcagcactcaaggaccggtcacctcggctcccttcctcgccatgccatacttctccaagctgttcgtcgtcgcgtgcgatgtgtcgtcccacggtttcggtgcagtgatggtcaggacggccaccccatcgcttttttcagtcgggctatcacaccccgacatcaggcgctggcggcctacgaacgggagcccattgggctcatcatggcggtccggcactggaggccatacctttggggacgctggttcgtcgttaaaaccgaccactacagcctcaagtacctgctggatcagtggctcgcgacgattccacaacatcactgggtcgacaagctcctaggcttcgatttctccgtcgagtataagcccaagtcgaccaatgtggtggcagatgcgctctcccgccatgacacgccagacgatggccgatggggctctcctggccctctcagacccgcgcttcgacatcgtggatcgacttcgttaggcgcagctcaccgactccgccctcgttgtcatgcatgacgaggtgcaggccggcatcaggcgcgcgccttgggcggtggtcgatgggatggtccagtacgtcagccgaccctacttaccgccatcttcaccgctgcttcaggagctgctggcagttgtgcacgccaaaggccacgaggggtccagcgcacgctgcaccgccttcgacgcgactttcactttcctaacatgaagcaggtggtccaagaatatgtacgagagtgccctacctgccagcgccacaagttcgagcatctacacccggccgggctcctacttcctctcccgattccacagggagtctggacggacgtggcgctggacttcgtcgaagccctgccccgagtacgcagcaagttcgtcatcttgacagtggtggacaggttcagcaagtactttcactttattccgctggcacacccatatttggcggagtccgtggctcaggcgttcttcgcgaaaattgtccgcctccatggtgtgtcgtagtccatggtgtcggaccgcgacatcgtgttcacctccaagttctggcgggagctcatgcgactgatggggaccaatctccacatgacatcggccttccaccctcagtcggacggccaatccgagtcggcgaacagagtcatcaccatgtacctgaggtgcctcacgggtgatcgaccacgacaatggctgtagtggctctcgtgggcagaatacctcttcaacaccacctaccagagctccctccgtgacacgccattccggatcgtctacgtctacggacgcgatcctccatccatgcgatcctatgagcgggggacacacgtgttgctgctgtggccagaaccatggaggaacgcgaggagttcctcgctgatgtgtgccatcgtctggagcaggcccacgtcgtccagaaaaagtattatgaccagggacaccgcgtcgtcacatatcaggtgggcaagtgggtgctgctccgcctccgccaccggtcccctgcctccctcaacaccgacaccaccagcaagctaaagcctaggttctatgggccgtacagagtgctggagatcatcaacgaggtcgctgtccgcctcaagctaccggcacgagcccatatccacgatgtgtttcatgtgggcgtcctcaagaagtaccacgacacacctccacaagctacgtcgccactgcccccgcttcaccatggggccgtcaccttggagccagcccgcaccgacaacaccaagctcgcccgtggagtgcgccaggtacttattcagtggaaggaccagtccccagcatcagcgacttgggaggacgtcgacaccttcagcgccaagttccccacattccagctcgaggacgagttgcctctcgaggagaggagagatgtcatgtacgacacacatatgccaggcacaggagagcccgcgacgtgcgacgggcggcagagcgagcagcaagggcacaggagcagcaggcaatcagctatgatggaaagtacctatctgattagtcatttcgctattttgaattggctaggatggtgcagcggtatagcctaccgtctgtatccggaaggtcttgggttcgagccccagcctctgcatattatgcgggtaaggcttggcgcttaaagatacccttccccagaccccgcacagtgcgggaagcctacgacactgggtacgtcctttttaggatggaaagtacctagctgattagtcatttccctattttagtttagctaggatggaaagtacctagctgattagtcatttccctattttgattagtcctacaatcatggagaaccttctccattttgtaaggccaccggccatataaccctgtacggaggcactttgaggggaagcgataatcattactgtccagccctctctctctctaagccggcgactggaagtttcacccagtcatcgttgaagctcgacgtgggggtataaccctgccggtaaccacggaccaaggctacgagctacgtagccgaggtcctcctgccttggacactaacgcacttgacaatacatgatttaggatttaattgttggagctcaatttttttagtgctctcaatactataatgtagtattttgatttttggggcactattttaatgaaccttgttggagatgctagccacgcatgcagtcagctgccatgcaggtttctcatctcagtcacgcatgcagcagaggcgcaatcacatattggagaagcttcagtcaagtctataatttaggatatttctatctagttgttagtggccaggagccattttatccactcgcactcggtttggattaagcaaaagagtttactctccaatctcccttctttctaatctcccccattcatcatagggcgtcaagggaagctgcccccatactctgacgtccttgacactgcaaaaatatatataacacaatttagcacatattccctctgttccgaaataaaatgtgttttagagaattagtggattcatataatatttaatgtatattttttgtacatatatatagattcatcatcatccatttgaatgtagacataaaaaacaaaaacaaaaacgactactactttaggatgaagagagtattttttttgtttagaatactaattatgtgatcaaaacatagtaaaaaaggatgcaaaaatttataaatgtttagagtgtgtacctagatgggctggcaccactgtttcgctgccggcccatatgcaatacaacaagcctttcgttaaattctaatttcaatttatcgcatccaatctatttgatgcattttgtgatctatcatcgatccatgttttaaaatgagaaaattacaagtttttgaatatgcatagatataggttaagaatttgtgtgtttcacaataaatgagcagtatactaagttctgacataattctaataaagtttatttatttgtctcgttttttcagtgcgcagaaaacgattgaacgttatagaacatacacaaaggataatgtcagcaacaagacagtgcagcaggatattgaggtaacttggttatatttcctgttaccaatttcaattcttgaatgtcgattttatcaagagattgtgtctatcctgtggatatatattccttaagataactagcattgatgggcctatgttgccaacagtatgataaaatttctagtggatgtccatcatttcccagctgatgattcttgtactgaaatctgaagcataaaactatactggagagaggctttggcagggtacaactgatgtagagctgaatattttaaaaggacatgtgacgtcgatatatacagctgaatattttaaaaggacatgcaacggtagatttttttagaagcttcgttcatttcaaaacttaaagaaaaatatgtgaatgtataggtgatataccatttggtagttttgatgtagtagtagtgatactaagattgtctggtccggacctaaactgcagcgagtaaaagctgatgcggatggcctgtcaaagagactcgaagcacttgaagcttacaaaaggcaattacctagctatcaaatactgatatccttatgtacctgcccacggactaatctgcgttgaggcggtgcaggaaacttttgggtgagaggttggaagactgctccattgaagagctgcacagtttggaagtcaagcttgagaagagcctgcattgcatcaggggaagaaaggttagctattttctcctggtggtcgtttttaattttacagcctataatggggtttttaacataacaaatgaattaaagctgcatccatatgcgcatgcacaagcagctcacgacttcatatcttctgatcttgcatggcagactgagctgctggaggagcaagtccgtaagctgaagcagaaggtaagcaccagcttcctgtccatacacctagcgacatagctagaagcatcagaaatacacggttcctaacttgtgcttcgttttatgttcacatctgtgtgtcgcgtcaacgtcaaacaggagatgagtctgcgcaagagcaacgaagatttgcgtgaaaaggtaatggtgccgaaacatcttacagccatgaggaccacaagacgctgcacgctttgattatactgcttacctcgacatcttatgtgcatatacagtcatgcatggatttctctcaccaattcgcgtgctgcgtgcatctgatggaaaccatgtctgcagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtcagtctgtgtatcatcccgtcccgtccgtcagagtctcagagaacgaacacttcttctccctgtagctagctgctcctgcttgtgtccagatcttctgttcgatcggttttgggagtagctagggagtgggtgtcgtgtccattgggcgacgcttcggccttctgcaaggaggcttctcgagatctctggtggtggtccccgcacggcgcctgaaattccatgctgacacgtgcatgcatcggaccggaggcagagtcacgatctcttcgccttcggaagcgatgggcttataaccgtccctgggctgaaaggtaaaaggccctctacttcctttgtaggcgatgggctgttgttgcaatagttctatgtaggtaagggagagttgtcccgtgggttggtatcctctaccgcaaaataaaccgatctttagaatcacctcacgaagtcaatattttatagaaaaactataatatctataacaccaaataaataaaatatataaatatagatctatatatatatatatatatataatatctatttaataatattaatttggtgttggttggggacaagtctatggccgaaggatctatggtgccgtttggttcacgaaatataacgtaaatgacaacgataatgattcacactcgagtactatcgataataagtttgaataggtcggtatcagttttctaatgtgttatctcattacgatttgacttaaacaaacatgatttaacattattggttatacattatgttacaaatatgtgagccaaacaacacttatattcataaaattaatgtttagatattttcttagggtaagattcttaatcaaggctgaacaacatgtttagatcttagagtcgagcattgttggccagcattgtagaactgttaggatctaccggtgtcatagattgatcgggcgatttctagtgactacaaccctatataggagattgagtcctttttgttttgtggcggctaggatttaatggaaatgttgggaatgcagattacgctcatcagtttcgttggattgtttgttactgagcaacatgtgtttgtactttgtatg

SEQ ID NO: 506 - protein, 232 aa, Zea mays
MVRGKTQMKRIENPTSRQVTFSKRRNGLLKKAFELSVLCDAEVALVVFSPRGKLYEFASGSAQKTIERYRTYTKDNVSNKTVQQDIERVKADADGLSKRLEALEAYKRKLLGERLEDCSIEELHSLEVKLEKSLHCIRGRKTELLEEQVRKLKQKEMSLRKSNEDLREKCKKQPPVPMASAPPRAPAVDNVEDGHREPKDDGMDVETELYIGLPGRDYRSSKDKAAVAVRSG

SEQ ID NO: 507 - DNA, 4845 bp, Zea mays
ctgcaccgggagagggcgaataaggtttttgggaagcgtcttcgcgcgactgctcgtgatctgctgacctcgtcaacccatctgatcctggcgcgcgccaacaatcagtaagtctaatcagtacgcatcatctgatttggcttttatttcagttcttctgatttggtcatgatttatattcggaatttaatttggaatttgtctaattattcaacaggtgcaatctccggcctctactcactccagatctattcttcgcttcgcctgcaggcagcagtagcaccgttcaagttcaaccaacgcggccaacgcacctgttgaagttgaaccatgcatgaacccgcgacgtgtttatcctccattatccacggtgagctctgaaatccacgttgactcacatacatacacggtacgcgcgtcagggatttcactcggaggcaagaatcgaaaaagaaaaaggaagccacgcgtacgacgtgcaacggggacacacatccacacggacgccgcgacgggactgcacagtggcaatggcaacgcaggtgcagtggtggtggtgttggagtgtttattattgcctcaccgtgtgcttctttttttatgttccagagcaagcacgtaatgtagtaggggcgtagaatctagactatcaaatcgcgaggggcgacgacggtgctcggtgcagtgcagctttgtacaggaacaggactagtcgttttcacgtcgtaacagagcacgctcccgcgtcgatagatcgctacgagcagtcgacagacacggcagcataaatgcgcgcgcaaaagctagtagtaggactaggcctacagtgcagtgcgtccccgagattcattcgtcaagttcaggtcgaccggccggccttgcccttgcattggaaaacagttaccgctatataacaaacagccgcggcgcacggcgagccaagcccgtcaaggcacgaggactgcaggagcagaaagttggcaaccctttgagttcctcactcacacgcgcgcgagccgagagagcatggatcccaacgacgccttctcggcggcgcacccgttccggtgggacctcggcccgccggcgcacgccgcgcccgcgcccgcgcctccgcctccgccgctagcaccgctgctgctgccgcctcacgcgccgcgggagctggaggacctggtggccggctacggcgtgcgcccgtccacggtggcgcggatctcggagctcgggttcacggcgagcacgctcctcggcatgacggagcgcgagctggacgacatgatggccgcgctcgcggggctgttccgctgggacgtgctcctcggcgagcgcttcggcctccgcgccgcgctgcgcgccgagcgcggccgcgtcatgtccctcggcgcccgctgcttccacgccgggagcaccttggatgccgcgtcacaagaaggtacggcgtataggagtatgtactcgtgtcacacacatacagacatacttgtatatatgctcagttttcttctgtagttctgtactagttctgtgtgttttgcctctgcgagcaatgtgatgtgatgatgtggtcgctggtcgatggtcgtgtgcatcgtgcctgcgttaatgcatgcatgcatgcggacagtgtccatgcatcagtctttgttgggactagagtcacgcgctctgctctgctcgcctgtgatgttacttgctcttgttcgatcataccgcaaactcgcagcgctgtccgacgagcgcgacgccgcggccagcggcggcggcatggcagaaggcgaggccggcaggaggatggtgacgacgaccgccggcaagaagggcaagaaaggggtcgttggcacgaggaagggcaagaaggcgaggaggaagaaggagctgaggccgctgaacgtgctggacgacgagaacgacggggacgagtacggcggcgggtcggagtcgaccgagtcgtccgcgggaggctccggggagaggcagcgggagcacccgttcgtggtcaccgagcccggcgaggtggcgagggccaagaagaacgggctcgactacctcttccacctgtacgagcagtgccgcgtcttcctgctccaggtgcagtccatcgctaagctgggcggccacaaatcccctaccaaggtacgcgcgcgcacacacttagggggtgtttggttacaccccgctaaaatttagctcatgtcccatcgaatgtttaaacctccgttccggatattaaatgtagtcggattataaaactaatttgtcagccgaagattaaaagacgagacgaatctagtccagttgattgggtctatatttcatactcctatttaaaagtcaaacgcttgatgtgacccgagctaaactttagcaggagcaaccaaacacccccttattcatttagcagagtaacatttttacatataatatacaaacggcagacgttttctgtatacgaacaactgtcgtgaatgtaccaatctttttaggtcgttgacaagctataacaatataatggtaaagaaaatatagtggcacgcaaagcgccaaagcccgctctcattacctaggactaggaggaaggaagcagcaaaccctttgtagtggaattctatatttcctgcgccgttaagtctatgctagtacatgtactacatcaccatagtatatgcggtcctcaattcaagtactcgtaatgatcgtgtagcacttgtacatacgtactgcttaaagtatattttgcttgagacgcacccgcactcgtggataaagcgagtgacgtgtcatcagtcgtcggtgccaaagcctggggtggctttgtgtcgtcttgtccggccctagggtcagacgggcatgcatggcatcgacactctctcggagtccgtggctgtgtgctgttgccaccggtttcgcgcgtaccagtacgactgtacgagccacgtgggctcgatttgtggcagtttggtggccggcgtacgagtagtctcgtgctcgcccccagtcttcagacggtgtgcgtcgaagtgaaatgaatgcacggtctggcctggacggattccagggtgattggatatgatgatagcttggtgacctactgacctgacccggacggccgcatcgatgcgctcctgcgtctgcgtctgcgccaggctagcccacccagatccagaccgagaccggccaggcgcgcgcagcttgttcgatccgtgagcagctgctgctgctgctgctgcgtgcgcacttgtgcgcgacgcgacacgacacgagcagcgagctgctctgcactgcactgcacgggaaccaaccaaccatggctgatgagcgacatgttcgcgtggcgcgcgcgatcgtgctcgtgctttgcttgcaggtgaccaaccaggtgttccggtacgcgaacaagtgcggggcgagctacatcaacaagcccaagatgcggcactacgtgcactgctacgcgctgcactgcctggacgaggaggcctccaacgcgctgcgccgggcgtacaagtcccgcggcgagaacgtgggcgcctggaggcaggcctgctacgcgccgctcgtcgagatcgccgcgcgccacggcttcgacattgacgccgtcttcgccgcgcacccgcgcctcgccgtctggtacgtgcccaccaggctgcgccagctctgccaccaggcgcgggggagccacgcccacgctgccgccggactcccgccgcccccgatgttctagcgtgcgtcgtcgatgtgtgcctgcaccgtcgccgtacgtctcacagttcctttttcttttagagtgtgaaccaccatggaaaattggattccctctcatatgatgttgccacttctcagttctcacttgtatgttgcgttgcccggttatagtcaggagtgggcttagatttaggcactgtttagttttaggactaaaagctaaaaaccaaaccaaaccaaatgtttccggaagtaacttttttttaaaaaacgactttctcgcagtccaaactgaaaacatggacctgcttttagcggctttcggatggaaatgtgaaaacatatatcaaaaaaatttaacatatattagtggtttccaccaaacggtttttagttctttaacggctcacaatccataatagttttttcatagtcacaaccaaccaaacagaacctaaattgcgcttgatacgccatgtttggactgttaggatttatgggcttggcccaattaagaatttctaataattcgaggaaaatctcaaaagcccatataagtggatggcaaagggataggtggaaccaatagtaccatattgctagctcttgtggagtagagctagcttaaatatggaagccacactcactcaccaagtcatggatgagaggagagagtgtggagagccacacgcgcgcgcgctcggctcgcctcgcctggcctggcctggcctggcctggccggggcgaagggcgcgggcgcacgacatgcgcgtgaatggtccgccgaaatccggcccctcgccttgcgggggcgcggctacctccttttgccgtttgattttttggtttcttggctgttacgcttatcctaaccgatccctataaaatctcaactgattgcgagattttcgtgggcggataagcacgggggtcgcggactcggccctataaaaggagcccggcagccagcctccaaatcatcccagatcccagttcgctttcgcctctcttcatagctgagccgccttttagttcccttcgtcccgaccgcagaggtgcatctgcgatcaggagagcaggtctccggaacccttcgtcttctagatcctgcaccgggagagggcgaataaggtttttggg

SEQ ID NO: 508 - protein, 391 aa, Zea mays
MDPNDAFSAAHPFRWDLGPPAHAAPAPAPPPPPLAPLLLPPHAPRELEDLVAGYGVRPSTVARISELGFTASTLLGMTERELDDMMAALAGLFRWDVLLGERFGLRAALRAERGRVMSLGARCFHAGSTLDAASQEALSDERDAAASGGGMAEGEAGRRMVTTTAGKKGKKGVVGTRKGKKARRKKELRPLNVLDDENDGDEYGGGSESTESSAGGSGERQREHPFVVTEPGEVARAKKNGLDYLFHLYEQCRVFLLQVQSIAKLGGHKSPTKVTNQVFRYANKCGASYINKPKMRHYVHCYALHCLDEEASNALRRAYKSRGENVGAWRQACYAPLVEIAARHGFDIDAVFAAHPRLAVWYVPTRLRQLCHQARGSHAHAAAGLPPPPMF

SEQ ID NO: 509 - DNA, 10339 bp, Zea mays
ttaaagaacaaaaaaagtatcttcattatttctttatgtagtaatccgtatacttgctttgcctataaattagagtgtattctcgcttcctgataagttcaaatatttttttgacattgaccaaacatatacaaaacattattaatatttctgataaataataagtatcgttgcattaatagttacttatttgaatatgtaaacattaccaatatttttttgaacttcaccaaacaagttacagccaccaaataagttgctttgtaccaaaaaagttgcagccgccagacttaacactgcacaccatcaaaatcaacgtttcagaccgttagataaccaatatcctttactcattcaaattcaatagacaatactatttggattatctctctccctcacgtcctcggcgcccctctccctcactcgcaccaccgttgtcgccgtcggcaccaccgtcaaccccttccctcgcaccgccaccggtattgtcgacctcttccctcatctctacgggatcatagcgttagcacaaactatatgctagtagatttaatgatctagtgtagtcaaattaaaaaaaattagtgagttactttggtaaccaatagcctccttttctagtatctgtacttccctagagcctagacaaggtgcaagaggaaaccaataaacgactcccaaatttttccaaaaggtttgcacagctcccaagtaaaagctcagttttagtacccgtgcaagttccacgtaggaatttaacagcaaatttttttttgattctttaacaacaaataaataataaaattagtccatctagaccctgtacagttcccacacgtttcaaacggacgaaattaataattacctaaaaatgtgcaggtcgtagcaaagtataattaaattaatacgaaagaataggcacggaaatgccggtaccaaagatataaaaaagggtagaggggaatggaagagtccaggagcaagaaacactcagaagctgcccagagctaccacccttcttatccccacccctcctcctcctaccttttctccttcagacctcaaaatctgtgtgtctcctgccgcggctagctgataggaacaagagcatgcacatccgagaagaggaggctacaccatccacagtaacaggcatcatggtgatttcttgttcttcccattggcttctttaatttggagcagatccacctctctgtgtcgttgtcgtctcctagcaattcttgagcgtggttctcttgtgtgcagtcgaccctgacttcggcggggcagcagaagctgaaggagcccatatcccctggtggcggctccgcgtcggtcgctgggtccgctgcggagaggaacaacggcggcaggggcaagggcaagactgagatcaagcgcatcgagaacacgaccaacaggcaggtcaccttctgcaagcgccgcaacggcctcctcaagaaggcgtacgagctctccgtgctctgcgacgccgaggtcgcgctcatcgtcttctccagccgcggccgcctctacgagtacgccaacaacaggtctcttctttctctccccagctctgtgcatctctctctctgtgtggtactagctagctagtaccgcaatataatggtagtaggcgctactacgacgaatcaccttcgctccaagaaatggtaggctacatatataagtgatgagtttgtcgtcccgtctagctagctagacacatgatgtgtatttcgacgacgctctccgagaattgaagcagcaagttagctcccagctttcttgcttgcaaagaggaaagctgcatctcgtttgctgctacgactacatgcgttctgtttattaactgtcttgcttattttttgtgctaccgcggagaggggcgaaagaaatcgcaacggtttctttgcgcgcgtgcgtgctccgtcatcctttccggtttctcttgtgttcctgtgaggtgagctagatgtctagatagattcagcgcaggggtatgctttgtgaggtgagcttttctagtgcgcgtgcgtgcaatgggcgggtgccttgcggttgctttggtttggtgtggtggtccgcttcttttcttgctccatttaattatttctttcctttctatgatctatatatccctgaggaatatcagtgaagacttattagatctctcatacctcatgatacatagcaagcattgttctcacacaaggaaaaaaaactttttgttgctttggtcatgtatatatgtgcagatctagtaattattatccttcgctcttagatttgggtcactagctggatgtgcgcgcgtgcagtaactcggtaactggatgcaaacttgtgaatgtgagtgaggggaggtaagcatttgagacgtaaaaagatgccaggcgcgcatcctgtcctgctagtgctatatgatgttagggttagggttccatcccatgtgcgtccgtcgtcatcatcaccatctggcctctctctctctcttctctctctctctctctctctctctctctctctctctctctcatgctgtcatacattgtgttttctgtagatgttactgttgtccctgcgtgtgtggtggttctgcaggtctcctcgtcacagccatgtatatctgcgcgcgcgctgtgcactgtgctgcatatgcatatgctaaagtgatgcgcaactgcccatcacgggagctctgtcctctctgccaccacatagcactgtagtttttaggactggcaggaaataaaaggggggtaatgtaatgcagaaggaaacgataacatcaaattgaaaacaaagaagcaacctagaaacagcgtgatagcaaattaaatttccttaggcatttgtgcttattttttaagatttctttatcacatccttatgttgcacacgtacatgcaatgcaagtggcatgagtgaacgaatatatagattcattacagctttgacaaattggaaccactccatctgattgaatgcgtttgacttgtaaactcaaaggacaatatgtgttgtgtttcttcgcagaaatttgagcattatgattgggttctcgtatcttcaagtgaatatttactgttaatagtaatagtagtgttcatcacactgaaccataaatttgagagaaacaccattttgtaagtaatcaaattacttttcttgaacagattccaaaagaatcaaaatttcatctatattgttgcaatattgaaactaaaaagtagctcggatgcattagtcaacatggtattgcaaatatttgtacaataaaatcatagttttgaaactgttgtatctatatggtgtttgattggttacttgtgtttgcaatgtattcaggcagtgcagattggttgtatttggtttgccagacatatatagtctcttattcatgcttgcactttgctcaaagaaagcacaataatgcatattagctagtatgccagatttggtcgtacttagacaaggtttgcacaatctgatgggatggtcatacaaaaataaaacaacctcttccctttacatatactaaaaatatgagaactcaaatagaacatggatcggaggtagcaataaagtgtgaagaaccaaacatattttttatacactgcatgtgtttctgatcgactcaggttgcattgcataaggtctaatgcagagaagactaatgcaagcaaacaattagagccataacatcttataattgatataaaagtatacctatctatttcatgataattttaaatataaaaggtttgctcaaataaaaatgcaaactataattgattttttttttgctcaaagctcgacggaagccagatgttcgaacgggtgtagctgcaattcatagagataaaacactgtagaaatattagagcgacctgtacgaattaaagtcaatcgacgctatagatatatatttggtctttgagggcgtacggggcaactgaaatgtgtgccaatttgtttgtgtgatgtgaatgctctgtatacggaaccagtagcatgaccagttttccttgccactgccagagttgtatcgggggactacaaggggaagaaagctggcaatgcaagctggtgttggtcagaagggttatggcacccaacggtagggctgaccagttgggtaacagctgagtccatgtcttatctatgcagcactcctttgtgaccaatgggtagtagatgtccactgcttgcaggcaatcatgttgtgggtaatgcatggctactgccaagcatgctcgaggatgctaaggtttttgctatgttcacctacagagtacagaacagcagtacctttgaaattggtagccatccgtctcaaaattcgttctcattttcgaaaatgcaaccattttaaacttacaaatatatataataaaatattaatattacataattagtatcgttagaagatctttgaatctattttcataacaaatatttttaaagatacaaatattacaaatatttttttataaatttaaatcagtcttgacaaactttgacctgcacgaaatgacttagacaactattttagaatggagagagcatataaattatgtgagtcaaagagtttcttagaaataatggttggcactaagtgggttctacattattgcccccataaatatttctttgaagcactgctattaaaatgcttggcctccgcgatggatgttatgagttccaaaaaaagtgacgagttcctgttaatctgtgtatggcaactgcaaaattggcatgtttagaaaatacatatctcgtgtaagcatagggttcaaatttgagtcaagatgcatgattcatgtctcatatttcttttagctagaataaaagtggtatttacatttcctttttgaacgtaagacatttacatggatatgtcatctttttctgacaaatatttagacaactgttttttaccatcaaagctaattaatgtgaataacacatcattttttagattagattgtttaattttttgcaatgaaaaaatcattcctttgaagaatcatgtgatccatctttctcctttcacttccgttgcaccattaacataagttatttaacaatacaatccatatgttcctttaaatttgtttatgtcctatttagtaaaaatatccacttaagcaacacaaagagagctggctcaacttaactgtgaatgcatcgaatccactaactattgcgcttttggttattatcaacaacaaatatttttattaatatatcaagataatctatattttatcagtttctcaatgtttcaagatttaaaaatataggtcttgagttttttttcttgagagggtaattttaccaggatgttttttggttcagttcaaaatttaattcaatcctaatgtttagatctagaccccctttttttaaacagttcttgtaggatttgactttgttgaagaaaacaaggatgaatttttttgctatgctagcttaggagttccgattttcttaaaaagaactgtagtagttattaggtgtggtattacataggttcaaactccatgtatgtgcactacaaacatattatgggtctgtttggtttagctgtagattcctaaaactctgattctagctatgagctgtgagaaagctactatgaactgacaattatgagaaaactgaaattaatttggctgaaacaactgtcaactatagattctataagagcatgacagcttgtaacatagacatcatgaatccataaaatctagggtaggaggtgattctgaattgaactagaggaatctatagtttatctattctactattgtatatgtttgattgagatttcagattttggacagcaaatctagttcagaaagctaaaccaaacataccatataagaactcaagttctatgtagatgcatcagtatttattagaatgctaactcaatggcagttaggatttgattatgctggcaatgcgatagtatacaatattagactattagtgaagagtgaagcagtaatgtaagcaatgcatgtgcttactaaaacgtgataaatcattgttgcaccgaatattaatacacaacattaggatgtgcttgcacttcctgttattatctgtagcattgacgaggaccactctctattttcacatgacactaaataatgtgttaaaatcaactacttctaagtgattgcagcagtatttaccacaccaaattaatatcacaaaatagattatgaaatatattttcataatttaaccatttagagtcctagatgatgttactatttaagtgattgctgggatggctttactttagcatggaagtattaatagtattttgggacgatgcgttagaatattggttactttatgtgctgattgtattgactttcactaatggggctgttctggctagattattaaagccgttcggactgctgctgccgtatagacaaaatactgtagaaaaggtagaagccggtggattaaagccgaaatactgtagaaaaagtagaagccggtggattaaagccgcaacggacaggatgaatgtcaaattgtaatcgacatacttgctagaaggcaatgtatccattataatcgctggaagatgtcaaatttcagttattgtatatgttctatgaatctccattataatttattatgcttgtgacgattgttctattatctgttgtattttttcaagaaaaatatctagttttgccctggaacaattttgtttcatattttcattctttcggcacatacaattatctcacctgattgaatgtatgtgtactaactactaactacagtattatattgtatgtacagcgtgaagggcaccattgagaggtacaagaaggcaaccagtgacaactccagcgcagctggtacgattgcagaggtcaccattcaggtaacatcatgtcgatcagtcaacacatcgtttctgatcctacaagaccctagtcgtagtgttggctaccacaggctatgctgtctattgatgaccctagtgttgtactatgcaacattccttgcaactgtgtgctctacacagccaaaatattttctctgggcgaaatcttcagactggacatgcaccctgtgggttctgggcattacacggcagaaattccagtgacgatactaagagaacctgcttggaccagcatttcatgtggagttgtgcagatatataattgtcctctctggatgtctgggtagctttggttattccatgctccaaatggtagagaggatagcatgcatgttttggacaaaaacgaataaaaccactgaaggctagtaggaaaattcttcttgatgggttttcgtaagatgtggcaattataatattcctctgataaatatatatatggctagtaggaaactttataagtatatatatggcagtcagtttggtgaaatggagttttagtgttgcacatattttcttttccctgaaattgatttcgatgaataaattaattggactacttttgttttttcttgcaattgagaaatgagtacaccatttaattcacattttgcagtcggacctgtttgttatgaatgtcaatatggaacatccactaacaatttggatagaaaccaacagcagcatgaaatattactaaatgaacttttgcaaacttgcagcattacaagcaggaatctgctaggctgaggcagcagatcgttaacttgcagaactccaacaggttcagttcttatagaaaattatcatgtgcgcgagaatacagaaaggtcatttgatgaacttataagttttcagggccctgataggtgattctatcacaaccatgagccacaaggaacttaagcacttggagactaggttagacaaagctctcggaaagattagagcaaaaaaggtactacgtgctatatatctataataatcatatttactgcattatgtgtggaaaaataaatatagtatttccttttacgcaattaatgcggatcaaactctgcagaacgatgtgctgtgttctgaagtcgagtacatgcagagaagggtaaacagcaacaagaacacatttttcctctcacgaacttattgatttactcgacattgaacaaaataaaaacaagaatttcgcattttcaggaaatggagttgcagaatgacaacttgtacttaaggagccgggtaagtaacctgtagttgctaattaagaaggacagtcttagaagcaaaatatggaactgtaattactaaaatgccaagtttaccttaactttgaaaataaaaaatagtgtaacaatttaactgtctcacaatgcaagcataggttgatgagaatgaaagggcacaacagacagcgaacatgatgggggcaccatcgacaagtgagtatcagcagcacggttttactccttatgatccaataaggagcttcctgcagttcaacatcgtgcagcagcctcagttctattctcagcaggaggaccggaaagacttcaacgaccaaggtagattttttttttatatctaccacatttatttgaaatgtatttaaatggacaccctaaggtatttcataataccatgtatatttttctaaatgaaataataatccctccatctcaaattattattcattttaattcttggtttttaagaatgatgatgaatctagacacatacatcaattattaactgtacgaatctattagaagtttaaaatgaattttaatttgggacagagacaatatttattagtcatcacaaaacttggaagccatagggctaggaaaacaaaatcattgcagttagttttaaataaaatgcctaaaccttccacttggctatatatatatatatatatatatatatatatatatatatatatatatatatatatatatatatatatatatatatatatatatatatatatatatatatatatatatatatatatatatataatttcctctccaagtacatgttctgctattctgattccttttaatgtctttaggtggaagataaatattggacctctcaagcttcagtacttatccgtgatgatgcatgactgccagtgagaaactgagctacattactgtggaattatatgtaaagactagtactactgcttcatatatgtgcatgtgcgcacacgcgcacgtagtatgcacaatttcatcccactattatggcttggcaccaactatgtctccttaattatcataggagaaaaataagtcacgcacaaaaaaattctaaagatgaggcgcagtgttggatgactgaaactgaaagataggattctcgtggatggcggtggtcatatatatgtcatgcacatctgatctctgttccaaaatgccacatcttctttcccaacccactcgaatctacaccgagaatatatatgttttattcgtaatgtatagacactattagcaatgatactgtgaactatggttatggtccacaataagaaatgcatatttacctgtggtttcatagtagaaatcatgtatttatgttgatgatcttcataaaaaatgttaggaaaaatcaaatttcaccaacaaagatgtatttctaaagatgggtttgaaagaaaagtggaccgtgactatttgatagttaaaattttgatgtttgatgatcaagcacaaccatttagactaacattatcggctagttttttttaatttaagggatgcaacatggacatggactgagataaagtggtgatcaacactacgggaaagcgggccactatggacgccctacataacttccaacggccgactcacagtctgtcagaaattaactaacttcctacggctagatgatagaccatcataaattaactaacttccaacgactggctgacaggtcgtactttccgacgacctatcagtcagccactagagtcaaccactagacgttggttaattaccaacggtctagcaaccaacagttcactaccggaatcacaggctttgccgagtgcagtacgctttgccgagtgccttttgtcgggcactcggcaaagaaggctttgccgagtgccgcactcggtaaagttaggaactcggcaaagagcccctttaccgagtgctgaacactcggcacagggggctctcggcaaagacacgttttgccgagtgtcaaacactcggcaaagggggctctcggcaaagggccgtcaacggccgtcccaaagctgacggccgttagtcgttgccgagagcctacggctggcactcggcaaagaggattctttgccgagtgtcatctctagacactcggcaaagtatatttttatttttttatttt

SEQ ID NO: 510 - protein, 286 aa, Zea mays
MHIREEEATPSTVTGIMSTLTSAGQQKLKEPISPGGGSASVAGSAAERNNGGRGKGKTEIKRIENTTNRQVTFCKRRNGLLKKAYELSVLCDAEVALIVFSSRGRLYEYANNSVKGTIERYKKATSDNSSAAGTIAEVTIQHYKQESARLRQQIVNLQNSNRALIGDSITTMSHKELKHLETRLDKALGKIRAKKNDVLCSEVEYMQRREMELQNDNLYLRSRVDENERAQQTANMMGAPSTSEYQQHGFTPYDPIRSFLQFNIVQQPQFYSQQEDRKDFNDQGGR

SEQ ID NO: 511 - DNA, 7752 bp, Zea mays
atgtgatctagagctaatcctgactgatagagaatatgctgctgaacatggcaagagagccatgtcaaagaaatccgaatcagcagcaataaggatgccgcccgaggcgcccagagaaggcaagtgaaaagcttgattagcaagcttggcgcctacagtttcctttaataaaacattggaccaattcgagatctttgtctcttgtaggcaaacaatggaagcaccggtggacagaattgtatgtctaacacttgctctcttcgcgtggtcatttagcccccgaacattccaagaaaaaatagcacatttttgattcataaggtaaagactgccactccacttaacacagcacgctgccaccacacatggattagcaggagagcctgctgtaaaatcctaacaggagggagaacctccaaacaagggttcgccgagcaaaaacacagcccgaccacaaccgacaacctgaaagaacaacagagatacacaggcatgctgggggacctagaccagcgcccagaagtaataacgccagcggagatacaaccgctccgagagagcctgaccatctgagaacacattggtcaccaaaagcaccaccaaccggcctagacaaagcagctcagttgacccccgcctcgacatcttcgatggccggcatcacctttctccccttctttttattcttcgctgtcttcaccttgtcttgatttaacagctccatgattgcatccatttgcttcttggagagaggctttgtgagaaggcttgtcatctgctcaaatgactcatcaaagttagtacattttgaagaactaattattattatatagaatgcactgcacatatattactattaccagttttcttgggcacagcagaaaacatgcacacgcagatagaaaaaggagaggccataaaccaaaaggctttaagaatatatgtaaagatatgtctaaatatatggctatatctggttaagcaagataacagggctctggtcatcagtagtagtggccttttgcccttgcccctctctctcacctctcttttctcagccttgcttccgatggatcccatcccactgccatcctttctttcccttgcgcgcattgcctagccggccggccggcctgctattaaaccactttacccgccccctctcgctcacgctcgacgcagctcccttttccttgtttgcttattgcaagtctctgcaagaacctgctagagaggaacaaggtagagtagtatcgcttttttccatctaggttatctctttttacatgaaaaatttcagccgtatttcgttctccatcagtcctgcgataatatatacgcgcgtcttgtgtgatccggcatatgtatagttcctgctaactgatcgagatcgctctcgtttgtactttctccctttgaggaaagagtttccccttttctgtgcttcaagttcttgtaaggaaaaccatgcctgccagcttcttctgctacttgtatgatgattcttatttgcttattacttgatttccgttttttttcttgctttctatatgtatgtatctgggctgtcttcccctgcgtctcgttactgctaagctttggaaggtttcaactctttgtatacgatgaggtttctgctcctagtagcagatccgcgcatatgactagatgtttgaggaaaagaaaagggcaagacgctatatatatatgcagcacgcagtcgcacatatattcagttttccaatctgcctcttgctttatgataattcaacttgcgctgattatattcttggctacctagaaatgtctaattaaactttgtttgctagctagattttgttgcttcctttcgcatctgatctttttatctcttctgagtgctccgcaaagccttccagtgttgaagaagctgctggaagaacgaagagatgagctttctcttgaaggaaaaagagatgatcattgctggtttgttgttgtttcgtgtttttttagcttcttgtcccccatttatatttcgcgcctaatgaacgagctcgtagatcttgtgttcttgtggctggttttgttggatctcgatctcggttacgtttacatgagtctactcttgcctaacatacatctgtgttctttttctaggctgagagaaacttaactgatcgagtctgcctggcaggcatcgatctatccagtcgtcagttcgtcacatccgctttttcgtatatatcatcttcagattttaattgtccatctgtcaaatcatggaaaatctgtcgtctttgcttgtattctcttctgtcattcctgctgcctccggcggatcaattcttgaatcgacccgtgttcctattcccttttgttagacagcccaaatcgcttgctcgatcgtagtgtactgtactactgcggctagctagatcttccaagctagctagttcgtcggtccctttgatctgctccacttgaactcttttgcgcttatgagaaaacttgctgctttcagctggtatcgccagcatgggtaggggaaggattgagatcaagaggatcgagaacaacacgagccggcaggtcaccttctgcaagcgccgcaatgggctcctcaagaaggcgtatgagctctccgtcctctgcgacgctgaggtggccctcatcgtcttctctagccgtggtcgcctctacgagtatgccaacaacaggtgagtgagccgtgtgaggtgcttagatcttggacaccctggtgaacgcttgatcatttttcagcatgtcatcatttcatgctcaagtcatcgacttgctgattgcgctgttgcgttgcgtcatgggcactcagcagaaaatggaatcttattcatttgtagtgcggcggcgcttgcgggatttagttcccgtttagaagtacccaatttttaagaaacagatttatagaaatttaggtagtaccaaacataccaatttatggcttagtttataaaaattggattactagtttcttagaaaccaagaagttgacctttcctaacttaaagataaaaactggtttttcaaacaacatcttagttcctctctcatcggtagttcatgaataaattgattagtaaggatttctaaaagatacaaaaaatcgtcaaaattgtcatatgttcagtggtcagaccatatatatatatatatatgtttaggagttatttcttcaaaattatgtgatggacaggaaagggcacagcgttcatcatgtataataatactgacagagacgaccattttattgccatgcaaatttacacaaaaaactaccacatgcttattggattttcctcatctgtgttagctaatataatgatttatcttgttaacccactacatgttatcgagttattaatcatatattgcattgtcatgtgatatatcttgtttgtgcatataataccgagacaaggattgactgactctatgtacacatgaattggaacgtaaccgtgcaaactgcaaactagtgcttctttcatgcattgtttgctattcaaatactactgttattagattttgattttagatctgagtgttcattcggatctatgtttttagacagatttagggtacatttggttggagagtcaactagaatagagtgactccattccagttatttagaataaagtcattcaattctgcgtttggcaagccgaacagagtcattctatttttttgtttgatcgaagatagagtggagttgctctgttctttatttggatggagagtcatatgaatgtagagaagagggagagggaggagagtgctcgtatccagtcattttggtggagctggagtattccaattatttacggtaaatttttatatgaagactttaggagccgctccacttcttttttgttgaaaaccaagtatccagaaaacaagaatagatcaactcctcaaccaaacacacctttactctctccctcggtttgttttggtgtgatttttaataataagttggtctcatcctcttcctagaagagataaaaccggatgtttaattttcatggcataaaaaaaatgttatttagattttcagagctaaaacatccgtgctctagtttccacacactaggttcaacaaaatcgataagaacaagaatgcatttgcgtagtggtagatgaaagtttgtcgcactgacgtcttctgccctgtcaaatgcctttacatgctcctcggtctctctctctcacacacacagaacacaaaaaaacaaggtcttcttgttgcactgtgtccgagaggacgttgcaacgtacgtactgacctgactctaaactagctgtcaagagttaccctttgctcgcatcccgctagtaccagaacgtacacctcagtcacctcgtcggcaaacttgcaccggctcacccccccatattcgcggtgcttgctctcccctctccgatgcaaagcgtcaatcaacaacaaatgcacgccgcagtgctccattcctctcctgtgcttcattctgccgagcaaaagtttttcaacagcagcagaggggaacgatgacaacacacacacagctgcattttattctttcaaaagtttcgcaatgggaagcttgttcacatgcatgcatgcatgcattgactgggccgggtgtagggaaaattttcacctcacaatttaatagctttcgcctgtttcgtgttgctgtggcctcgagaacacagaaggagctataggctgcattgtcacttcagtattactgacaacacaccatgcatgcatatgcatcctccatgccttttgctttgttccactaattgattggtctagctgctgcagtgtcaaggctactattgagaggtacaagaaggcacacaccgttggctcttcctctgggccaccgctcctagagcacaatgcccaggtaatttatacctttgctgttcttacagtaaagtacggtggtcattttatgatttacaatttctttccatacacgtagccatccatatgcatgcattgagagattcttctggaagtaacttaatttgacattagtactagggctgtagcgcatatgctaaatatatacacatactgaatctatatttcttgatgatcatgctgatcgagaaccaatagcgattgaatgacccggaaatttctaaaactgaaatagtcatacacctgaacaaagtagttgtcagaccccctcaatattccatttacttaatttggacttggataatgtccaaaattatgagatccatgcatccatctgatcctttcctccaactctttgttttatatgctgaagcaattctaccagcaagaatcagcaaaactgcgcaaccagatccagatgctgcaaaacactaacaggtacgtagagaagccttgtgcagaatttactctctctaaagctagagaaccattggtaacaactgactgacagtacacacgtactgacgtactgcctgtattctctgattatttttctcccttgtgaaggcacttggttggtgattccgtgggaaacctgtcactcaaggagctgaagcagctggagagccgccttgagaaaggcatctctaagatcagggccaggaaggtaagaaatgtatagcattatccaaaccatcttcaagcaaactaatcatataaactaattaagtgatactcaattctttatatactgtgtatatttggccacatcaattaattgcttcccaagactccttttgtttcaataatcttcaagttctgatgtaattctgagttgggctttggataggttgttgccagacattgacttctgaattcttgtttcagagtgagctgctggctgcggagatcagttacatggccaaaagggtaatgcacacataaacctcattttagctaaccctattggattcattcgtttgcatcatatcatgcatgtccgcaggagactgagcttcagaatgaccacatgaccctcaggaccaaggtatatatgcttgcttgcagcaattgtagaactagctagaacccaatcttttctttttcttgcatatatagccacctagaccggaaagtaaagaaaaaactacatgattagtaatcttgagaattatttatgcatctgtggtagctgaacattttgtcaattgtcttgtcagattgaggagggagagcaacagctgcagcaggtgaccgtggcacggtcagttgcagcagcagcagcagctgccaccaacttggagctgaacccattcttagagatggataccaaatgcttcttcactggcggccccttcgcaacgctggacatgaagtgctttctccccggcagcttgcagcagatgctggaggcacagcagcgccagatgctcgccaccgagctgaacctcggctaccaactggcgccgcctggttctgacgctgccgacaataaccctcatcatcagttctaaactggatgcatgcacgagaagcttttcaagcgaactgtgaacgatggaagctggctgttgcctctagatgttcttggcttccatgacctagcttattatggtgtgtattgttgttgccttttgtgtgtgattctccttgctactctactgatggagaactaaacctaatcgattggacataatgatcaaatgctacagatcctgtgatgctgtgatcaggttaaggcaaaacatgtatactgattgcttaaatgggtttacgagtgacgacaatgctatttgttgcttctattactgctcaactctctcttgcttccggttttggacacaatttgtttgacatggtattctgcacacaactttgggtgttggtttttgtccttactactccacagtaagaatatttcaaaaaactgggatgcatgtgttaacgcgatcagtggtgcggaagcaattgtttggaagcttgctttgacctggcagcgttgcgtgttagtactttttataacaatgagtacatggacggccaggtttatctccagcagattatattggctgtagcctcagacgtagctgactccaattcaacatatatatctaattatcaagctaaattacatgcaacgaatatacatgagttggtttgggttacaatgaataccgactttatctaatactccccttcattctcaagctcataagagattgagattgtgcttgagattctccaatttatgaactgccataggcttcttaaaaccatcagctaattgatcatcgatcagacgaaatgaaatcaatgtgaagaagtttatttgctaccatttctctaaaaagtgatagtcaatttctacatgcttcgttctcccatgaaacgatggatttctacacagatatttggctccaatattattacaccatattctagcttgaggaggactagggattccaatatctttcaacagaatatatatccacataatttatgtcgcaaccttagccattgctttatactctgtctccgtgctagatcttgatacaacgggttgtttgcgtgcactgcaagaaattaaatttgaacaaagaaacacgtcaaatcccctatataatgccagtaatccaaacaccctgtcaagtctgcattagaaaaggcacttacaagaagagagttagacttgatggttctaagtccaatatttgcactcccctttaactatctcaaaattcccttcaccacaacccaatgttcactagttagagcgtgtaaatgccgacaaaccatgtttacatcaaactaaagat

SEQ ID NO: 512 - protein, 269 aa, Zea mays
MGRGRIEIKRIENNTSRQVTFCKRRNGLLKKAYELSVLCDAEVALIVFSSRGRLYEYANNSVKATIERYKKAHTVGSSSGPPLLEHNAQQFYQQESAKLRNQIQMLQNTNRHLVGDSVGNLSLKELKQLESRLEKGISKIRARKSELLAAEISYMAKRETELQNDHMTLRTKIEEGEQQLQQVTVARSVAAAAAAATNLELNPFLEMDTKCFFTGGPFATLDMKCFLPGSLQQMLEAQQRQMLATELNLGYQLAPPGSDAADNNPHHQF

SEQ ID NO: 513 - DNA, 3395 bp, Zea mays
atagcttgggatggcatgaggcgagacctctgcccctttatttataggcaaggtggaggattaggggaggagacgagaattagtgagagataaacatgtattagtcatgtataattgaaattagcttgtagatctcactatatgacactggaggtgtatgcatacgtatgagcatgaggaaaattattaagaaaatatttgtagggactttaaaaatgattacgagggtatttctgaggagaaaaatattttgagaaatattaatggaatctttaggcagtatttctggaaagaatttgatggagtcactggaaaaatatttgtaggatattttgaaaagaattttggagagaatatatagcactatattttatttgttgtgatgaacttgcaaacaaacatttgtaaacacaattttaaaatccattttaaatttaggactagttcaagtaattttatggttttgaatttttcggaggctataatcaccctaatccaatgagtctctacttacgcgcttgctttccccttaactctacaaatttctcgagtacctaagaaacactaatatcgtcatgcaacgacaatgttcatctaatttttatgaaaaatttatgcctattggacaaatattaaggttggatgaaatagtgagaagttaggacataattatggtcacggttagttttaatgtatgtcccctccacgtctataactcttcttttactagtagctacaatatctaaaacttacttgctataactgagggtataatattcctatggaagtgttagtagcttgtgaactttcttatggttaaaactgtctatccatatttaacgtgattggctgtttatttatttagtattcattttagagtcagcagtgatttagcggagaaagggagagtctgggcaattggcggtctctggtgtcatttgaccagtgccaggtctcagtctgagtctatagtcaacagtgatctctcggtcattggttggcagtctcaggcacacacaatgacacaacacaagcagggcacagtcacagtgtgagctgagctgagctgggcttgtgcttgtgcttccgcctcctcctccgcggctactaaagggtgccagccagccagccctgtggggcgccggtgcgtgcccaaaacaagcaagcataagcatagaggtgggcatcatagacatggaggatgacgaggacatatgggcaaacaccgccagcagccccagcgcgtccccaccgcagcccgtggcggcgggctcggtctccacctgcagcgccttcatctccacgcagctgagcctcaactcccgcctccacctcctctcctccgccgcggccgggggcgggtcctccccggtccgcggcggcgcctacggcgcggacggtgtccgccaccaccacatggctctcggcggtggcttccgcaatgccgcggcgtcccaggggtccttctttccgtacaacctcgccggcgccggcgccgatgtcgcgcccttcgacggcggccgcggcgtgctcgaggacgacatgtctgtcggcgccgccgcgtccggcacctgggctggcgggggcaccgaccggcggaagaagcgcatgatcaagaaccgcgagtccgccgcgcggtcccgcgcgcgcaagcaggcgtacgtccgcgagctggagacgaaggtgcagctgctgcagcaggagaacgagagcctccgcgtcaagtacgacgaggtaagcgggacatcgagagcccccggcccttcatatatatggtcgctttgctcaaagctcgcgcgtggattgggcagctgcgggagtccgtggaggtggcggtgccgatggtgaggaagaccctgcagaggatgccgtccgcgccgttctgaggacattgaccggagatgagtcgaagcaggtggttgctcgttttgtttgttttttgaggaggtgattaagtaagtgactgattagtgagtggctgctgcctagtgcttggttactagtagtggtagaactcagaactacatagatccaggaagcaagcaagcaaatccttcctgccatggcggcctcaatgtacatagatcccatgtttttattaatttcgtctagctgggggggcgtgcacctgccatggcggcctcctttatttagctttatataagtaggatgtaggatgtctaccatatgtgtgtagcttgggattaggctgcaagaagataagcctgcttgtacaaatatggcttcctggaacaatgacattttgggggcgcaacgcaagaaagatgaaagaacaatccaggaagcagcaggtgttttcttcttcttcttcttttgccccttccatgatattcgcgtgtcaaaggctctcctaaagcgagtagtagtcttttggtttggtgaatatttgctgttttcatgctggtccctgctgatgtttgcgatgattttacaatcagaaagagacgttttttggttttgcctccattctctttttgttgctcagctttggcgagggggaaagccagtaatttcgacgatagggaacaaaaaatggatcgaattttgggacccctttgcttttctgaaagatggaacagaaggcaaacaaatcctgactattgggaggatctaatttttccttttttagacaatgtagagcagctgcttccctacaccaggcaggaggcactggaccacagacacgcaaacagagctgcaagtctgcctccccccaagcaccctgctccctccgatctaataactgattttaataaatcaatccattaaagtttcaccatatatatatatatatatatatatatatatatatgtaatgttgatattcattatacgagacaagtatcattggattaatctgaaaatgtattttttaacaataaatacattaagagatgcaaagttttttttttgttctataaacctcaacttacttaattatatgattacattctttctaggaataagtctatatatataatcccctgtcgtttgacatcatagaatgtcctttgaaaatggaagcttaaccccctaaccttcataatgccgtatatagctggacaagatttctttgcttgagatcaagggttacttaagggatcacatgccagttactgatctactactgttgcatcggttgaagcctgggatgcagttaggtgatggattggttttgttaactgatgatgtgtcttgtaaaaaaatgtctgatcacacaaccgatgcgcggagtagcagatgtgtatgtggagggagtgaatttgcaagcgaatgaatcatctgcatgtctccttctaaggatccaaaagttgacagcatgtttacaaataaacaagaagaagtgaaaggagattcaggtaataaacagggaa

SEQ ID NO: 514 - protein, 204 aa, Zea mays
MEDDEDIWANTASSPSASPPQPVAAGSVSTCSAFISTQLSLNSRLHLLSSAAAGGGSSPVRGGAYGADGVRHHHMALGGGFRNAAASQGPFFPYNLAGAGADVEPFDGGRGVLEDDMSVGAAASGTWAGGGTDRRKKRMIKNRESAARSRARKQAYVRELETKVQLLQQENESLRVKYDELRESVEVAVPMVRKTLQRMPSAPF

SEQ ID NO: 515 - DNA, 3537 bp, Zea mays
acttcaacaagagtacaagatactaaccctgtctgaagcaagtccccttgtaaatgatgttaaggcaccatggctcaccgccctgctacccagtacccagccacccagaaaaataactatacgcagctgcaagttttttttcttcctattcttactttaggacatctacaacttctgaattcaaatgaagaaacaacacccatgcaacaaagagagcacaaaaaaggcagtaactactaactagtatcacactacctcagatctgcagaagttgcacacaacaaaagcaaaggcttcagcaattcatttggtgttaacagaagagtcatgtcccttccatgacgagaactacctcgtcagcatcagttgaagaacttccagtcatacatggtgttaatgcacccaatatcacagtcgaagctttgcaaaggggacgtgttttgttattcctactgtaatttatctgcgatccctaggtttaaatagtacaagtcccatagatagatcttctgtacaacatgtgggttctcaacaacgggaaatacaactcaaggacagtgtatggtgtttacgtggaaccgcggaagaacaaacactaaggtatgcagcacaaatttcagatcagacgaaaagagaaacaagacaacactacttagatatttaacctaatatgctcttgcaagaaaaataaaacatactaaatacacctcgatgttcacaccactacagttgactgcactaaagctgccagtagtttgcgtgctttgctccagcaaaccccagcaatgttttaataactaagttgctgaagcatatcactgaaaagactatgcagactgactacactacagagatcatgctttgacaaagtacgttaaaaaaatcatgctttgacaaagaagcacacttcagctatctgggtgacgtatgacatcacaatggtatctcaaatgctggaagttgaataagacagccttcctcaactccagtataaatagttcatgctcaggctgcagcttcctcagtcccatagggttatttttctgcagtatttgtcagcaaccgatcctttggttatggctcgtgtcctacaggatgtgttggatacctttacaccaaccattccactaagaataacatacaacaatagtcaagttctggcaggtgctgagctaaagccatctgcggttataagtaaaccacgagtcgatatcggtggcaatgacatgaggactttctacaccctggtgagccaagcaatttacagataatgctacccgattgggagaatgtatgccaatccttttttatgtagcatataaagtattgtgcactttatagtggatttatcagcattagtatgaataaatttaataagaacaaaatgccttaaatcttgcagtatataaacatgtctatatgctaacatgtttgtctttgacttgagaaggtactgattgacccggacgccccaagtccaagccatccatcactaagggagtacttgcactggtaaataaagtgcaatatgtcccactcttcctaaattaggttctttttaatttgccttattatgatattggttcactattgtgtaggatggtgacagatattcctgaaacaactagtgtcaacttcggtatgaatgcatatagttatctgtcattccgttgcgtttctgctgaatactgtggagcttaggctgtagtctcttcttgcttctcggacttgttgaccactgaattggtgcagataatgatgcaatcaatacatgaaatcagcaaccataaactgaatgctagaccaacttgttaggtgaatgcaatatcccagcttagcgcttactgaaagccactaacttagtagcataactaataaagcaatcaggtagaactcagtttcaatctagaccattgccggagtctggatatattggtattaaatacaaacaagtatttaatagtgtaaatgaataggtatacgtatgattcacaaggcccatgtttgtcctttaattggttggcaacatcagcaaaattaggttcatttacagtggtcatattaaagttatattctagtagtacatttttagtatatataattttttcatgcttggttttacctgagactttgaaacagatattggaaacaaagaagccattaattgtctcaaacaagatgagctatatctaaaagacatctctttgtccaaattgaaagagttaaaaacaataaatgtcgatgtccccacacacttcagtgttccttaaactcttcagtagataatgtcatgatgttcttgcaggccaagagctagtattttatgagagaccagatccaagatctggtatccacaggctggtatttgtgttgttccgccaacttggcaggggtacggtttttgcaccagaaatgcgccaaaacttcaactgcagaagctttgcacggcaatatcacctcagcattgccagtgctacacatttcaactgtcaaagggaaggtggatcgggtggaagaaggtttagggaagagtagagaccatagaccactgcatggctacactatataattatcatcaataatgtgcactatattgaatgtcaatgcaccacctctatatgctgaatgctatgtatctcaaactatgatttgtaatgacttgaaggattgagagcttattctcttaacggaatatagaccaatattattagtatatattccatgattaatcagacaaagtattctccaaggagaaaccagtacagtttcagggccatactagtactgcttgtttcaacaggtattaaacaaactcagcacaatctgaataatacaaagtatatttcatggaaaactaacagagaatcacagattgtatattattccttactacaatcagaagagcacaacacatcattccttattcccattgaaagtattatgccagtggtacgtaccagtttcttagaaagtagtcaacaagacactacaaagcattataaattccaagagttaacttacagcagaatcaccatggagaggaaactaataacttcttctcaagagccaagatggcacacctccaccaattcccatgactccaaggttttatctgtggtatctgttctatagagcgcaagctcagatatctcaaactctaatacatagatatccttgtccagctcctctgccttcttccttgcctcctccttctcctcatctgtaaggtctccatataagaggctgacatgcggcatgtatgctgcaaatgccacaaccaagtgtcagtagtcactaacatatgaattctcattcaggaacaggattcagcgagcacactcacgagtttttctattgtaaccgaagttggcgcagcagtgatcgctagctcccaccacctaacaaatttcagagaatctgatataagaaggccaaatgattccaatgcacactgcatccaggggcggacccacagggggtccaggtgggccatggcacaccctaagccagatccaccaagaccctcacctggcccca

SEQ ID NO: 516 - protein, 192 aa, Zea mays
MLRLQLPQSHRVIFLQYLSATDPLVMARVLQDVLDTFTPTIPLRITYNNSQVLAGAELKPSAVISKPRVDIGGNDMRTFYTLVLIDPDAPSPSHPSLREYLHWMVTDIPETTSVNFGQELVFYERPDPRSGIHRLVFVLFRQLGRGTVFAPEMRQNFNCRSFARQYHLSIASATHFNCQREGGSGGRRFREE

SEQ ID NO: 517 - DNA, 3749 bp, Zea mays
aaattgcatttaacctgcttcaacaagagtactagatactctccctgtcagaagcaagtctccccttgtaaatgatgttaagacgccatggctcaccgccttgctacccagtacccactacccaatccagccacccaggccttcctggtctaaactcaagtaattcagctgtaattttttttcctattcttactttgcgacatctgcaatttctgaattcaaatgaagaaacaacacccatgcaacaaatagaccacaaagaaggcagtaactagtatcgaactagctcagatttgaagtacttgcacagaacaaaagaaaaggctccagccattccttcggtaataacagaagagtcatgtcccttccatgacgagaactacctcatcagcatcagctgaagattccacttattcatggtgttaatgcacccaacctcacaatcacagccttgcaaatgcgacgtgtttcgttattcctactgtgatttatctgtgatccctaggtttaaatggtataagtccatagatcttctgtacagcatgtgggttctcaacaagtggaaatacagctcaacgccagtgtatggcgtttacttggaagaacatgcactgagtatgcagcacaaattttcagactagactagaagagggaaatgtcgaacctgatatgctcttgcaaggaaaacaaaacgtactaaaatgcacctcattgttcacaccactacagctggttgcactaaagctgccagtggtttacatgcttttattactccagcaaaccccagcaatgttaataactaagttgctaaagcatatatgcaacctgaaacaccacagagatcatgatttggcaaagaagcacaattcagctatctgggtgacgtatgacatgacaatggtatctcaaatgctagaagttgaataagacagccttcctcaactccagtataaatagttcatgctcagactgcagcttcctcagtcccatagggaggaagttgagagttctaataagagcaacggccaataccattagcgagttatttttctgcaatatatgtcagcaaccgatcatttggttatggctcgtgtcatacaggatgtattggatccctttacaccaaccattccactaagaataacgtacaacaataggctacttctgccaagtgctgagctaaagccatccgcggttgtaagtaaaccacgagtcgatatcggtggcagtgacatgagggctttctacaccctggtaagccaagcaatttacagataatgataccattttggagaatttatgccaattcatttggtatgttacacataaaagtattatgcactttgtaatggatttatcaatattagtttgaacaaatttaataagaacaaaatgcctaaatcttgcagtatataaacatgtatatatgctaacttgtttgtcttcgacttgaaaaggtactgattgacccggatgccccaagtccaagccatccatcactaagggagtacttgcactggtaaaaaaagcgcaatatgttccacttcctagatttggttctttttcgctttgccttattatgatattggtccactattgtgtaggatggtgacagatattccagaaacaactagtgtcaactttggtaagaatgcatatagttatctgtcattccattgtgtttctgctgaatatagtatctgtggagcttaggttgtagtctcttcttgcttctcagacctattggctaccattgaactgatgcagataaggatgcaattaatacatgaaatcagcaaccataggctgaatgctagaccaacttgttaggtgaatgcaatatggcagcttaccgcttacatgcatagtaatatcatgaaatccactaacttagtaccataactaaagaagcaatctggtagaactcactttcaatccagcccattactagagactggattatcgatattaaacacaaacaagtatttaacagtgtaataaactggtatacgtatgattcacagtgcccctgtttgttctttaattggttggtaaccttgaggtgtcaatttcagcagaactaaggttcatttacagttgccatactaaagttactcaagtacactttttagtttacatagttttttcatactcgattttacctgagactttgaaaccgatattggaaacaaagcagccattaattttgtcaaacaagaggagctatatttaaaggcttctctttgtctaaattgaaagaattaaaaacaataaatgacgacgcttccacatacttcagtgctccttgaactattcagtatataatgtcaggatgctctcgcaggccaagagctaatattttatgagaggccggacccaagatctggcatccacaggctggtatttgtgctgttccgtcaacttggcagggggacagtttttgcaccagaaatgcgccacaacttcaactgcagaagctttgcacggcaatatcacctcagcattgccaccgctacatatttcaactgtcaaagggaaggtggatccggcggaagaaggtttagggaagagtagaaaccataggccactgcatggtcacactatagaaatatcatcaataatgtgcactatattgaatcaatgcaccacctctatatgctgaatgttatgtatctcaaactatgattgtactgacttgaaaggttgagagcttagtctcttagcagaatatagcacaatattactagtatgttccatgattaatcagacaaagtattctccttggagaagcaagtacagtctcaggatcttactagagtacctgcttgtttcaacaggtattaaacaaactcagcagtctgaattatccaaagtatatttcatggaaaacaatcacagcatcacatagtgtatattattccttgctccaatcagaagagcacattataccttattcacattcaaagtattgtgccccagttgcttagaaagtagtcaacaagacgctataaagcattacaaattctcagaattaacttacagcagaatcaccttggagaggaaactaatcacttcttctcaagatggcacacctccaccaattcccatgactccaagcttatatctatggcatccttctataaagcacaagctcagtgatatcaaactctattccacagatatccttgatcagctcatctatcttcttctttgcctcctcatcaattcatcatcatcatctgtaaagtctccatataagagtctgacgtgcggcaaccaagtgtcagtactaagtagtcaatagcatgtgatttttcactcaggaacagaattcagctggtacactcacgagtttttctcctataaccgaagtcggcacagcagtgatcgctcgctcccacctcctaacaaaattcagataatttgatataagagagccaaatgatcccaatgcacaagcacaatacaatactgcatcagcatttcctctggatttcaaacctgctggaagtttgaaactcggagcaaaacaaacttaactacggaactagtacgaggagaagagatgcttaacctcgggggtgggctccagaaggaggtagacgcacacgcactggtagaagaagctgccacgggcaagccccgtaacacggactgtgtaaggttggacgccggcggggagtacctcgacggcttccaagcggctggaactggaaggcggggccgcccggccgactaacgccgcacgc

SEQ ID NO: 518 - protein, 175 aa, Zea mays
MSATDHLVMARVIQDVLDPFTPTIPLRITYNNRLLLPSAELKPSAVVSKPRVDIGGSDMRAFYTLVLIDPDAPSPSHPSLREYLHWMVTDIPETTSVNFGQELIFYERPDPRSGIHRLVFVLFRQLGRGTVFAPEMRHNFNCRSFARQYHLSIATATHFNCQREGGSGGRRFREE

SEQ ID NO: 519 - DNA, 5680 bp, Zea mays
taataatgtgttgccttgttttttattgtgtacaacaattaaaaacgagtgaccaacattttcatgtcagggtatggggacccattggagactcgatatccaaatgaggatgagtatatgatgaatcctatacctatgatgagtataagtatgagaatcaggatgagtataacttcatcagaataggtgcgggggcgtccttgtgggcgtgcctaccgtgcgatcgcacaaggcctccaaaaccatagggccccaaaatttataacaatctttatatacaatataaataaaaaatattattttatataaaatatttaccaacatatagcatagaatcgtaaaagcgttgaaatcgatctgttcttattgttattcaaactatttacctccagcacattgtagtcattagataaaaaagattgagatcttattgtcactatcttaagaagacacagttaaaagaggtagacaatatgtcaatatgctttgatgcaagtgaccaattcgtgacgttgagtttcctctaagattttgtttaaaaaattgctatgttgacattctaaattttataaagcagaggagcaaaactgagtaaaatcgcatttaatgataaaaatgtggaaagtgacaaaactaagaatacaattttaaatagtccaatatttttttactatcttttgcacagggcctctcaacttgggaggacgcttctgggtgtgggtttacaaattcgatgaaaaattccccattgacaaacgataggaggatatttttctcccagcacaaaatagcatagccataaggcaacaaggcatggcaaaggatcgtatcatcgtcatccgagacccattgctttctctctctctcctcgtgctttcattactggggtgggggtggagtggaccagtggagtggagaaatgacaaatccaggcccgcaggcagccccacccaccaaatcggccgagcagggtgcccaaatcaggaaggattttaaggttaaccggctgccaccgcccaccgccggtgaccccagtctctcttctatctatatattacccgcctccttttctcctctctctccgccccaccctccttcctcagctccgttgcgcaccgccaccgccggccggccagccgccggagcaccgaaagacccccgttctttcctgtaaaaaaaaacccgccgcctttagctagctaaccggtcgtcctcttcaccccctagctttgctagctctagctaggaacgaaagaaattaaaggataactgagattgctgattggtggtccgggtacggtgttcttgagtcgtgaagcgacagtacagtggctagggtcgtgccgcccctgcagtctccggggttgcgtgcaggatggtcgtcagggatcgggagtgaggaggcatcagctctcgcggtcgtggagcctaaatgtaccgcaacaacgactcggcactctcctgcttctacctcttcctcctctggttcttcttcttgaagtagacaccaccagttcgccaggtagttagcagcccagttgcgactggggatcggtggcgggctgccgcttgcgagttgtaagcttggaggggaggggagcaggagcaggagatgcagttggatctgaacgtggccgaggcgccgccgccggtggagatggaggcgagcgactcggggtcgtcggtgctgaacgcgtcggaagcggcgtcggcgggcggcgcgcccgcgccggcggaggagggatctagctcaacgccggccgtgctggagttcagcatcctcatccggagcgatagcgacgcggccggcgcggacgaggacgaggacgccacgccatcgcctcctcctcgccaccgccaccagcaccagcagcagctcgtgacccgcgagctgttcccggccggcgccggtccgccggccccgacgccgcggcattgggccgagctcggcttcttccgcgccgacctgcagcagcaacaggcgccgggccccaggatcgtgccgcacccacacgccgcgccgccgccggccaagaagagccgccgcggcccgcgctcccgcagctcgcagtaccgcggcgtcaccttctaccgccgcacaggccgctgggagtcccacatctggtcagtactaccactgtctacaactagccacaccacaccgattgcttccgactctcattaatttctgacacaaactctccgtcttcctcctcttctcccgcgacgcagggattgcggcaagcaggtgtacctaggtgagcaagagcagatctcttttgcgttcccaaagatttttccccttttagttccttatcccatcccatctcgaatggcctagctaaccgattcagtggtggtccggctgctggccgatatacgcaggtggattcgacaccgctcacgccgctgcaaggcacgcactggactggacgcccagaattcttcgtcatgtgagtctctgaccgaattgattgattaacgagtctctggctcctggaactcgcagggcgtacgaccgggcggcgatcaagttccgcggcgtcgacgccgacatcaacttcaacctcagcgactacgaggacgacatgaagcagatggggagcctgtccaaggaggagttcgtgcacgtcctgcgccgtcagagcaccggcttctcgagaggcagctccaggtacagaggcgtcaccctgcacaagtgcggccgctgggaggcgcgcatggggcagttcctcggcaagaagtaagaaccaaccaacgcttcttttctttttcttttttttatagcatgcagtgatgattcaaccttagttgtgcctttcctcctaatcctatatatgtaggatttagtactggttgactatataagtatatatgtattgttcagtaaaagtatacataggttagctgcatgtttatgtatgtagctggttgtttcaatcagaagataaaaaaaaagggaagtagtggctagggaattcctccaatcctcaccggtgggaacgccgtgcttgggtgcaggtacatataccttgggctattcgacagcgaagtagaggctgcaaggttcttcatcttggattctgccgttcatatatgcataatcatgtcttttaatttccaaagggttgagtaccgactcgattcctcttcgtgtcttttttctttctttcttcgaaatccagagcctacgacaaggccgccatcaaatgcaatggcagagaggccgtgacgaacttcgagccgagcacgtatcacggggagctgccgactgaaggtacgtattttctttctgcatatatatatcttcaggtattattggctattaaactgcttggatcttactgcttcttctgcagttgctgatgtcgatctgaacctgagcatatctcagccgagcccccaaagagacaagaacagctgcctaggtctgcagctccaccacggaccattcgagggctccgaactgaagaaaaccaaggcaagcgctaacgatagatataccttgacaagctagtatcaaacaaaaccagtaaaaaaagtttactttcttgtcgaatttcattgcctacctgatgtacgtacttgtgcttctgcacaaaataacgaaatccttttgccctctgatgatgatgcagatcgacgatgctccctctgagctaccgggccgccctcgtcagctgtctcctctcgtggctgagcatccgccggcctggcctgcgcagccgcctcaccccttcttcgtcttcacaaaccatgaggttaggtgacagctactgatcgagatgcagcagcagttcaaacctgtctgttccaaggacctttaggccggattaccaaatcatcggtcaactgtcctgtctgttatatatttatgtgttaatttataatacaagtgtgactatttttcaaaccttccttcaaaatgcatgaaaagagttttttttaacgaaaggcgaaaagaaaatatgatacttgggacaggagcaagcttggatcatcagaaagtattattaattaggatcactgagctgttcattttgttcttgagtcaatcctaatcgtactatgtcagtgaatgaacttgtgttgcaccaatgcagatgagtgcatcaggagatctccacaggaggcctgcaggggctgttcccagctgggcatggcaggtggcagcagcagctcctcctcctgccgccctgccgtcgtccgctgcagcatcatcaggattctccaacaccgccacgacagctgccaccaccgccccatcggcctcctccctccggtactgcccgccgccgccgccgccgtcgagccatcaccatccccgctgagagaatcaagaagccgcactgtaaatctgccgggaagctagcattttccccccggcccctccccctctccgggcgttgcgactttttcagttttgcgccgccggccggggtggtggtttcttgtagccgatcgattggattcctcgtattactgctgcttacactcccaattaagtgaaaaaaaaacgctcctctactctttacactacacacactgttagctgatcgattggacgtacttgctagctgctgttgctgctgctagcttgagattgactaacttcagcacttggattgatctatatctatatgactatatagacgacacattgtgtacgtgtagataatatttcttcttttcctgaccgccataaaactgtttactctggccattttgaactaaaggctagctacaaatgagtgtccttctcggccttctacatgttctggtcatggacatcgagagatcaaacttctctgtcctgcttactagatacgtactagatttacttagcctagatagattccgttccaaactcgaggccaggcgcatcgagatccgagaacttcatccactcgtcgctcatcatgctgcatgcatgatggtctcaactctgaggcatgcaaacgcagtgagacgaactgggaggaatttatatagagtatatattgtccggcctgttggtgataaagatagaatgcatgcacgctaactgccaacatgcatgggtgctgcatcgaatttttggtatggtgcatgcataccgtgcattggtgctctgctagtactaggaccaatctccatggctccattagatctcttgtttactcgtctccatgtgcctctcaaagtgtgtactagctagttgcggcacacaagttggcagttgtttgttgtttcagcggggaagaaggaggtcaccgttgtcatcgtcaggggcgaagctaggatcagaagacagagggggcaggcttagcctccaagcgaccaaaccagtaagaacacaatataaaaatggcaagagaaccaaccataatatatatattgatatataatcttcattaaaaaacagtataatgaaacaacatctattttgtcaaacaaaataaaattaaatctcagttattttgaatttagctctacgtgtattagctagatcataggtgaaagtcgcctagagggggggtgaatagggcgaaactgaaatttacaaatataaacacaactacaagccgggttagcgttataagtataaacgagtccgcgagagagggagcaaaacaaatcgcaagcaaatgaagagtgtgacacgcggatttgttttaccgaggttcggtttttgcaaacc

SEQ ID NO: 520 - protein, 470 aa, Zea mays
MQLDLNVAEAPPPVEMEASDSGSSVLNASEAASAGGAPAPAEEGSSSTPAVLEFSILIRSDSDAAGADEDEDATPSPPPRHRHQHQQQLVTRELFPAGAGPPAPTPRHWAELGFFRADLQQQQAPGPRIVPHPHAAPPPAKKSRRGPRSRSSQYRGVTFYRRTGRWESHIWDCGKQVYLGGFDTAHAAARAYDRAAIKFRGVDADINFNLSDYEDDMKQMGSLSKEEFVHVLRRQSTGFSRGSSRYRGVTLHKCGRWEARMGQFLGKKYIYLGLFDSEVEAARAYDKAAIKCNGREAVTNFEPSTYHGELPTEVADVDLNLSISQPSPQRDKNSCLGLQLHHGPFEGSELKKTKIDDAPSELPGRPRQLSPLVAEHPPAWPAQPPHPFFVFTNHEMSASGDLHRRPAGAVPSWAWQVAAAAPPPAALPSSAAASSGFSNTATTAATTAPSASSLRYCPPPPPPSSHHHPR

SEQ ID NO: 521 - DNA, 4927 bp, Zea mays
tattttattttgtaccgtgtattgatatgaatcttagattttatgcaatattagttttttcgatataaatggtttttttgtctcccatagattttcctgctggctccgccactactcctcccgtagtcccgtgctaaccattaggtaaaatccggccaacttctgtgcttggttccacccgagagaaaggagccgggacaagctggcattcacagcttcatgcggctcccacccttgtcagagcacaaaatccggggatctggcccgtgaagctggtcgtgctcgtgggcacgctgtctggctgtggctgattgaaagctgagaagcagcttgtgaagtctggtctcgaatccgtgccattgccaaacgtcccgtgcaacagcagagacgtccggtttgtactccaaaatccactcttcgcttcgcctgcagtcggcaccgccgttcaagcaacggccaccgcacctcttgaaccatgaaccctaagtatccttatccacggtgagctctgaaatccacgtcgcctcacgtacagtactccccatagatttcagacggagctggaagaaaaagaaagcctagccaccgagacgtgcaacgggacacatccacgacacgaacgccgcgacgggactgggcaatgcaggtggtgtgggagtatttatcagcctcgccgtgtcttctttttatgttccagcacgtaatgtagggcgcgtagaatctagactatcaaatcgcgaggggcgagcgacgacgacggtgcggtgcagctttctacaggactagtcgttttcacgtcgtagcagagcacgctcgcttggagcagccgacaaacaccaagcgctagtagactaggactacagtgcagtgcgtctcgcaagtccacgggcctcgcattgcattgcaaaaaaaaaaaaaaaaaacagttgccgctatataacaggatccagcgcacggcaaggcggcaggcaacagcaacacggagtcaaggagcacgagttaggttggcaaccctcgagagtcgagagcatggatcccaacgacgccttctcggcggcgcacccgttccggtgggacctgggcccgccggcgcccgccgcgcccgcgcctccgcccccaccgccgcccgcgccgcagctgctgccccacgcgccgctgctgagcgcgccgagggagctggaggacctggtggccggctacggcgtgcgcccgtccacggtggcgcggatctcggagctcgggttcacggccagcacgctcctcggcatgacggagcgcgagctcgacgacatgatggccgcgctcgcggggctgttccgctgggacgtgctcctcggcgagcgcttcggcctccgcgccgcgctgcgggccgagcgcgggcgtgtcatgtccctcggcggccgcttccacaccgggagcacattggacgccgcgtcacaagaaggtatacacagcatggtcaaattgtttgcctctgtggtcgtgcactcgtgcatgcatgcggacagtgcccatgattcagtcatgttgagttgagttctgcttgccggcctgtgatgttatttgttcttgttcaatcatatcgcaactggcagtgctgtccgacgagcgcgacgccgcggccagcggcggcttggcggaaggcgaggccggcaggaggatggtgacggccggcaagaagaagggcaagaaaggggttggcgcgaggaagggcaagaaggcgaggaggaagaaggagctgaggccgttggacgtgctggacgacgagaacgacggagacgaggacggcggcggcggcgggtcagactcgacggagtcttccgctggcggctccggcggcggggagaggcagcgggagcaccccttcgtggtcacagagcccggcgaggtggccagggccaagaagaacgggcttgactacctcttccatctgtacgagcagtgccgcgtcttcctgctgcaggtgcagtcccttgctaagctgggcggccacaagtcccctaccaaggtacgcacacttattattaatttagcagggcaacgtttttatattacatatgtataaatccatttggtggtgcatacggatagctagattgaatgtacgataaacaaacaaaaactgtagtgttaaaaaacgtaatgtaatgaaacaaactttttaggtcgttgacaagctaggtactgtttataatttgctctaaaacatgtgttatatattctcagacacagttggagtcacacaagttaagggtcagaactctattaataatttaatacgaagacgtaattctcaactttgttagtagtgaaacggtttaagggttgactaaagttatatataaaaatactaacatttatgatgttaaataagcacattgttagaataataatgaagtatatctagttggtatataattaccaatactatttgctatagtaaatttgatcaaagttagtctagttcaactttcacaaatcctagaaatacagatactattcattgtaataacatcatagtcatagtaaaaaagatctagtggcatgcaaaaggcccttcacatcacctagaaggaagaaggaaatcctttgcagtggaattctattatattttgtgtaccgtaagtacgtctacagtagcacatgtgcaaaagatggtctatatagtacgccgtagtagtctgtagtcaagtacttctacgtacgtgtactcaagtatattttgctacagccgcacacgcacgtagatgacctggaaaaaggcgcgacgtgtcagtcatcggtaggctgccaaagcctgtgcagcttgtgttgtcttgtccggccggccccaggcctcagatacagataggcatgcatggacgccctctcctctcggagtccgtggcctgtgtgctgttgccaccggtttcgcgcgtaccagtacgagccatgtgagctcgcttttggcagtttggccggcgtacgagtagtcgcgactcgcgtgctcgcccgcagtgaaatgaatgcacggcctggcctgtccggattccagggctgattggatatgatgatagcttccctgacctggacggctgcatcgatgcgctgctcctgcgtccgcgccaggcgcacccgaccacaccggccagtttcacgacaccggaaccaatcgaccgtggctgatgaaccttttttttttttgcttgcactgcaggtgaccaaccaggtgttccggtacgccaagaagtgcggcgcgagctacatcaacaagcccaagatgcggcactacgtgcactgctacgcgctgcactgcctggacgaggaggcctccaacgcgctgcgccgggcgtacaaggcccgtggcgagaacgtcggtgcctggaggcaggcctgctacgcgccgctcgtcgagatcgccgcgcgccacggcttcgacatcgacgccgtcttctccgcgcacccgcgcctcaccatctggtacgtgcccaccaggttgcgccagctctgccaccaggcacgggggagccacgcccacgccgccgccggcctccccccgcccccgatgttctagctgcgtcgtcgatgtgtgcctgcaccggcgcggcgccgtacgtctcacatcgcagttcaggctgttccatggcgccatcgaaaagtggaaggcggccttcgtctgcctctcatgttgtcgctttgttcgttgcgttgtggttagtcagaagtgggcttagatttagaatggggacgtcacttgttcggccgagcgggccgggaaacaatttactgtttcgatgggccacttgttagtttgttacctcgcggccttactaagttgtattgtatccctcgtgatagttgtcccccatcctccaaaaaaaaaacccgacggtgtaccgctcctgtgatgatatatcctaagagtaaaatacattttcattacttcaacttatatgacgttatatgttaactcggtccataaacttttaaagtgtgtcagtctggtccttaattgttgttccggtcttagttaggtcgaaacgcgtcgtggttgacatatgaaccccacattttagcctatgtatctattttatctctctttcttggttctctctcaccgtacatgcggaaaagagagacaaaagagatacacatgctcacatgttgggggtccatatgtcaatcacaacctgtttggatctaactgagacccaaacaacaattaaatatcggattgacacactttaaaagtttgttaaccaggatgacatagggcgacaagtttcagaactgtaaatgtattttaccctatatcctaattatgctgtaacagtagcaccatttttttgctccttcgtattcgctctaattgttgaatggttgggaatgactaatatgtctctttgactttcttataaggttgtctctcttatacaccactcttagctcattcgtgattttctttggttcattctaatagtcaagttgtaggaaatgaaaactatctctttgaccctattctctcttttacgatcatccctctctccatgttctctcttttttcaacctttccttggtcaccttacctaatttgaaagctataaaacttccattggtgcaagactactgatgttaggttagtccgcatatgaatgttgcgacttatcccatgtacgtgtagctaatcttttatcgctcttaaccttacatcaatactctctcacaatacaactctttaaacagagatatgccaccaacggtactccgacaaggactacagagtgacaccactgtcacctccattcagattacacgattttgagtctgatggatctagcatagcccctccacctctaataacaagcactagagatgatcaactagcctcacttattgagcatatgatatagtagcaatagcttgccacaaagcagtagaggattgacaa

SEQ ID NO: 522 - protein, 394 aa, Zea mays
MDPNDAFSAAHPFRWDLGPPAPAAPAPPPPPPPAPQLLPHAPLLSAPRELEDLVAGYGVRPSTVARISELGFTASTLLGMTERELDDMMAALAGLFRWDVLLGERFGLRAALRAERGRVMSLGGRFHTGSTLDAASQEVLSDERDAAASGGLAEGEAGRRMVTAGKKKGKKGVGARKGKKARRKKELRPLDVLDDENDGDEDGGGGGSDSTESSAGGSGGGERQREHPFVVTEPGEVARAKKNGLDYLFHLYEQCRVFLLQVQSLAKLGGHKSPTKVTNQVFRYAKKCGASYINKPKMRHYVHCYALHCLDEEASNALRRAYKARGENVGAWRQACYAPLVEIAARHGFDIDAVFSAHPRLTIWYVPTRLRQLCHQARGSHAHAAAGLPPPPMF

SEQ ID NO: 523 - DNA, 6967 bp, Zea mays
gattgatatcattaatatatgaactaataattagaaaattaaaaatataatcagacatgatatatagaaccaacgtagtcatgtaccggcaatatgaataaattctcggactcatttacaacttttcatacagatatggagtttaaatggtaaaaataagaaaaaattatgcacaattgttggctctaaacccacgttcacatccacatagtcactagaacacatgtttttatgttttatactctatattcaagtatattatagagattttatagaaaaacaatgaaataataaaataaggctaagtcatgtcgtccttaggtcgaccaaaatcttgtcgggccaaatgccactcatcatacctgatttatttggacatatatactcgtacactagtgttgcactcgcgttatcagataacattaattgcatttaagtaaggtctatattaagtgtacagatactggcgcaacacacgagcacttagctagtaccaatttataccttagtttatataaattagattaatagttttttttaaaaacaaaaagtcaccttcttataactaaaatataaaaccttattcttagggtctgtttggttaggatattactgtagaaaaagctgctatgggctgtgagttgtggaaaaagctgttgtgagttgtgagctgttaaaaagctaaaaatcgtttagtggaaattattaaaaactattaaaaatttttcgatatatgttttcacagttttatcaaaaactattaaaaccatgtctagagtgttttcaatttttcactacgagaaaactagcttttagaaaaagttgctttctgaatccagctatttgatttagcttttgatttttagaggacaaaagtcaaaaccaagaaccaaactaaacacatcgttgagatcgtctcctggagaggctgccacggcggtgcgagggctcctcttctccaacgctcaacaaccccgcaccccgactccaatcccggcaccaaccctagctcccgaagaggcagaacacaaaatcaacggaccaccggaacaggaagcaacagcagcggggcgccggtgccgtacccttcactcattccgcccctgaaagtgaaacgtacccagatctacaagctactccactcgacttccataaataccactcctgcgattccaccttgcagttggaccggccgttgttgctttgcttcttcgcaaaaaaaaaacaaaaaaacaaaataggcctgtcttgctccgatcaggcgtgttcttaggcttcgctgcccctaccgcgtcttcgccgggatcggtccatggccggcgccgagcgcgcggaggcggtcgcgctggaacaagggctcctcgatccggaggttagttgagtctaccacttccactctccctccggttggcctttcctccatacttagataggttttttctacttgtattgaggggctttgtgtacttctgtttagatttagtggatgttttggtcagactggtagcctgttataggaaaaatcatgccttggcgcgcctgattaagaagaatacgagcccaactgcctgattgatttagtaagcatttcttaaagacagcttggcaccaccactacgtcgagattgcagtatttgttgttactttggctggacgacttgacacaattcttgggcaaaaactgctgtgcaatactatcgtcgtgcaatcaaaccatcaaaagttatgagaaattcttaacaaaaaaatatagatttacttcattatttactctatcaatatatcaaattttcaagttttaatttatcgtatattatgagttatatataaaagaaaattatatcaatataaaggattaagaaatgatagaattttctcttttttatatctcctaatgtagaatgaattagaacttgaaattttttatattggtagagtaaatagtgaagtatatctatattttttaaaaaaaattataacttttggtaatgtgattgcacagcgattgcatggcaagcttgattgcacaacagtttttgcctaaatattatgctttattttatatgtttggtcatggagtcatgagtagagtttgggataacaattggctattgcagtgttaatgtgaagctttactctctttttgttcactttatttcaaagagattgattggtatacttagctgagcttgagcctaaacaatttatctttttggtcctttcaactcttggccgtgtcaaaaatcaccctgtgttccagggcatttcttctttgttgttcctcagccgatgggcatattgctgtagttgcttccttttgcacattagtgttgaaagtaaagcctgtgcttgaagtgcttcaatgtattatggtttgcatacataatcaaatttctcttgtctgtttgtattcgtgctatttgtttaacaaagtattaacaaatcttggctgcaggaatccaaccaagtagtatacactggagatggatcagtcgacttttctggaaatcctgttgtcaaggaaagaacgggtagatggaaggcatgtccattcatattaggtattgtccagagtaaatttactaactgtgtgcttccaatttaatctccccataacctgcaattaactgttaagattaacctaggtaatgaatgctgtgaacgactggcctactatggcatctccacaaaccttgttacttacttgacaaaaaaactgcatgctggcaatgcctctgctgctagcagtgtgactacatggtcgggaacttgctacctaactccacttattggagcaatcctggctgatgcatactgggggaggtactggacaatcgcaacattttccacagtatacttcatcgtaagtcatctttgctcagaagtgtcatggtaacactcttggaaagggacatgcaagtaatttgtttcttttttgactgatgaataggccctcaattcttagtagactacgagcttttgtgtaattcatgtttagcccatacacatagtgcgacattcaactaatcctggaatttccctgttagtttgttattatttaacatgacatcatcttttcattttataggggatgacactgctgactctttcagcatcagttcctatgctcatgcctccatcttgtgaaggatccttttgcccagcagcaagcccttttcagtatactgtcttttttcttggtctttatctgattgccctgggtactggtggaattaagccgtgtgtctcatcctttggagcggatcaatttgatgatacagatccagctgagcgaatccagaagggctctttcttcaattggttttatttttcaataaacattggtgctctcatatcaagcagctttctggtttgggtgcaagacaatgtaggatggggactggggtttggcattccgactgtattcatggggctggcaatcataagcttcttctctggtacatcactttataggttccaaaaaccaggaggtagtccaattacacgagtatgtcaggtgattgttgcctctttgcgcaagtggaatgtgcctgtcccagaggatagctctctcttgtatgagctacctaatggggtatcaacaattgaggggagtcggcaaatagagcacacagatgaactcaggtatgccatcttatgagatgatagtaaaagcaactacaaactgagatagtttgtgaagctctgagataaacataatagtaacgaaagggcctctagctaagttggttaggtggtttgattaatgattagcactcctcgggtcctgagttcgactctctgtgggagcgatttttaggttgtggttaaaaaaaatcccctcgtatgtcccatgccaaagcacaggtccaagatccgacaccgattgcggttgttctcacatgggctatggtgcccttgtgtatgggtggggtaggggttcgagggttttctcgacctgcgcgagaaggccttcttcttaatataagatcgtgggggtagtcttacccccgcatgtcgagttttttttttataaagataatagtttgattgattgtgatacttcaaaaactgcgaataattattcttagtaaagtatagcagttgatgtcactatgacacttgtaagtaacaaagttctttgcataggaagtgtctatctgcccatgaacaagaactcgttcagaaataaaaaatgcgctaggcctgacaaatagctttcttttactttgtgcttgaatcagacattcaattagacacgcttaagtgttcagattcttccattaaatcagcacattatacctttgtgattgataagcttcccaattcagtattatttgtttttcaatgcatctgtcttgaattgtaaataagcaaagcagaaagttactcttggagaaaagcaacctcatgcagaaatagatttcatgtactgatggggatggcaaaatgattttgatgtcatctcttatttataatttgaagtctcttgatccacctagatgtatgagtctggtatggtatgctatttggtatatacttgcaagtttgcaacacatagtgcatgagagtcggtgctcacaacatatataattagtgcatggagtgtatagttttggaggaattatttaccattaggggttatgaattatttagaaataatatgtttatattatacctagcagagcaccatagtcaagaacaaaattttaattggttacttctgaaaatagttttttttctagttgttgtatatcagttcctgatttttgcttttctggaattatgtttatatactaaattgcaacttgtaagcacacatactagtgttttctctctgttatttcgactaatagataatatctataccttgtaattatcccgaagctaagagcctaacatatttgaaccgattttttattcagatgtttagataaggctgctacagttaccgaagttgatgtgaaaacggctgacttcaacaacccatggcggatatgcactgtcacccaggtggaagaactgaagatactagtaaggatgttccctgtctgggcaacaacaatagtgttttctgctgtatatgctcagatgtcaacaatgtttgtggaacaagggatggtgcttgacccatccttgggctctttcaagatccctccagcttcactatctactttcgacaccctaagtgtcatcatatgtgtcccgatgtatgattacatcgtggttccgatagccaggagattcactggcaacgagaggggctttacagagttgcagaggatgggtattggcctggtaatttccatcatggctatgtcagtcgccgcagtcctcgaaatcaagcggctagcagttgccagggaagcacacctggtggatcagaatgtcccggtcccactgagcatattctggcaaatccctcagtatttcctgattggtctagcggagattttcacattcattggggcgctcgagttcttctatgaccagtcaccagacgccatgaggagcctctgcagcgcgcttaatcttctcactactgcgtttgggaactatctcagcacgttcattttgacaatggttgcgtactttactacgaggggaggtaaccctgggtggattcctgacaacttgaacgaaggccatcttgattacttcttcttgctcatcgctggcatcagttttctgaacctgattgtttatgtcctctgtgctggcaaatacaagagcaagaaggcagcttgagttgtgaaggccaggggctggatggcgtgctgcgcgccatgttatggtggacacttcagttcaaaatctgtatatatgtttcccgcattaaccaccctagctgaagcaaccatctgcaattgttgcaaagtttatattcttcattgtgctggactaagttgattatacattcgtgcttctactttgtgtatgtatatatctgacctaaagttgctgaacatagacaatttcacttgcctctggtatccagggttttgattgttttttaacctagatatgtgaggtcacgttttaacttttgtatgtagagtaagcatcaatgtgctggttgaacaccaggagggcttggggcgtacttatggtgttttttgttggacgtgaatggaaggggtggacgggtggtcacatttttagtgtttggatgagaattacgtgggggcgagataaacaccggagcaatttttagtgttggtatgatcttaaaaaatcgaggatggtatcgcttcccgtctcatcctactttaatctcaaaccaaacatattcttacttttccgtatatattacatggtagcccgttctgacattctctgatggcacgtcgtgagttgagagttgactggttttggtttggttaaattggttgtctatcagaacgcgtaattggctgccgccttgtttgttatggtttcactacggaaagatgtttactggaagctgacggaacgtgcaggctaattggcagtagtaatacatgagcgaatgtaggttcgttccagccttccaggacagtcaactctcagcacgttgatccctgttgccctcatgcctgctacatcagcaaccggaccgcaatgagatcctctgcaccctgcagttggggtcgctgatgtagggtccaacttaggtatgaccccatgcgtcagtgacgctgcctgggtatgatcccatacgtcattgactcaactgcagggatctgtttcacaaccggaccaagtctcccgaagaatgataggctcggctgttgtcgtgtcctagactatgcacaacggttacacttaaacactctcctaaagctttgggctcgttcggtaaggcctagtttgggtactctaataatgaatgagattggagtggattgagatgtattgagagagtatttgatctattggggatttacaccctctctaatcccttcaaaacactctaatcccaaagtat

SEQ ID NO: 524 - protein, 587 aa, Zea mays
MAGAERAEAVALEQGLLDPEESNQVVYTGDGSVDFSGNPVVKERTGRWKACPFILGNECCERLAYYGISTNLVTYLTKKLHAGNASAASSVTTWSGTCYLTPLIGAILADAYWGRYWTIATFSTVYFIGMTLLTLSASVPMLMPPSCEGSFCPAASPFQYTVFFLGLYLIALGTGGIKPCVSSFGADQFDDTDPAERIQKGSFFNWFYFSINIGALISSSFLVWVQDNVGWGLGFGIPTVFMGLAIISFFSGTSLYRFQKPGGSPITRVCQVIVASLRKWNVPVPEDSSLLYELPNGVSTIEGSRQIEHTDELRCLDKAATVTEVDVKTADFNNPWRICTVTQVEELKILVRMFPVWATTIVFSAVYAQMSTMFVEQGMVLDPSLGSFKIPPASLSTFDTLSVIICVPMYDYIVVPIARRFTGNERGFTELQRMGIGLVISIMAMSVAAVLEIKRLAVAREAHLVDQNVPVPLSIFWQIPQYFLIGLAEIFTFIGALEFFYDQSPDAMRSLCSALNLLTTAFGNYLSTFILTMVAYFTTRGGNPGWIPDNLNEGHLDYFFLLIAGISFLNLIVYVLCAGKYKSKKAA

SEQ ID NO: 525 - DNA, 6481 bp, Zea mays
atctactgctcattcaagaatatatgtggttttataaagatggaccaattaaaggtgcactcaatctatgtcatctatggtgaaaaggtgaaacttctatatatattaacaaccaattttgctacatgatacgatatctgtaataataattttatacttaattatgcaccgctatatttttaaattatatctttatctaaaaccgaaagcttttccgtgattaatggtaaccggtatagaaggttgcttaaaaggaaccacaacacttggcatggcagtagtaaatataggcactataccattgtctggccacaaaggtactttagcacactccgcatatctttcgtacaatgtgttgatacatatggtggatatctagaggacattgcttgttgttacatcacaacttcaacaattatagtcattcatgcatcagaaatcactggcattccttcaccacaatttgtttggcccaagtaacttattaatagcttttggtatcccccctctctaaaatcactaatgataacatacacatagcttgatttactcatgaaactatagcataaagtaatctatctagtgcccattgaagaatatacgtggttctatggagatgaaccgatgaaacgcgcactcaagctatgttatcttcggtgcgaaggcacaacttctatattgacatccaattttgctatctgatatggtatctctaataatatttttatacgtaaatatccgccgttaaatctgcaccgctatgtttttataattatatttatttgaaaccgaaagcttttccgtgattaatggtaaccggctaaaaagattacttataagaaagcttaagatctttaacatgaatgaatgccatacatcaaggatactatgccatcctatatatgtccacaaatatactctagcatgacggtaatataatgggatatatataccctcataaatcatggatactatttgtaaggactttggtatttgtacagtcattcatgcatcagaaactactaaaaagcaaaatgaaaagttaatctatgtagattttgcattgcattcccctcaaccaagcaagcatccagaggaacgaaggacaaatgttattcaattttgtattgctttcccctcaaccaagcaagcagcccaaagaacaacaaatggcattcccatgagagaaaaaaaaaatacttgtaggtggggccaccctcccctacctatatatacccctgttcacgccgttcccaagaccacaccaccagtccatccatcctgcgctgcgctgcgctcgtgacaagcatcgcaagcagctcctcctcctccccctgtagccaacaccttcctgttccgggcgcagtagcggctgtcggccctcgatctgacgagccatgacgaagcacgccgcctactccagcgaggacgtggtcgcggccgtggcggcgccggcgccggccggccggcatttcacgtcgttccaggcgctgaagggcgcgcccctcgactgcaagaagcacgccgccgtggacctgtccgcgtccggggcggccgtcgtgggcggcggcccctggtttgagtccatgaaggcttcgtcgccgcggcgcgccgccgacgccgagcacggcgactggatggtatgtactgtactgtactcccggccgcgcgtcttctctctctctttctctctatctgtctgcacctgcacgcgacgagatcgatcggcccgcgcctcactttccgtctgcaggagaagcacccgtccgcattggcccagttcgagccgctgcttgccgccgccaaggggaagcagatcgtgatgttcctggactacgacggcaccctgtcaccgatcgtcgaggaccccgaccgcgccgtcatgtcggaggaggtcagcgagcaaccttcgccccccgggccgttttctcacttcttcccgatgcaaaagattccatttttcttttctgttctattttagttaaaaataaattaacggacgataaatattcggagttataacaatataaaagaaatgaaaagaaaaaaaagttgctcttttcctactatggcagtagcagagcatgctctgttcgttttcgttttcgttccctggaactgtcggtccctgtgtttaccttaacctgctgctgtaattaatatatatagtaaccgaatgacggaccccccccccccccccctctgtgatttgatttcctctgtggcctcgctcagatgagagaagccgtgcggcgcgtcgccgagcacttccccaccgcgattgtgagcggaagatgcagggacaaggtacattattccgattcggatcccgtcaactcctctccgttccgttctttcttttcgctgcttcaaattattactgtgtccatctctgtatgttgaagaagaatgtgtggtgtggactcggccttggcgccttgtagttgcacgctgtatagcccgcgcttccttgcacacacacgacacgagctagaaaaggaatcttccaggtttcctttttctacccggcgagttttaaaatctcacctcactcactcacgcgtccgtaagaccgtgacggcgtctggctgtgcgatcggaccggacggagccacggaggaggaggaggaggaggaggaggaggaggaggaggaggagggagggagctgatgagaagcgcgggcgtctgcttttgttttgtttctcatctaggcttcgctcgctcgcctccttgcaccttttctcctgccgttctttctttttttctctttattatttgtctgcacccgctgcggctaccttttcttccttcttctgcgagtccgcacgcctttagttttgtttgctagtagctagtagtagcactctgggaaagcggcagtagtagtacgtaacgtacctgggggaagtggagtggtgtatttatggccatggccttggtgcaatttataggtgctcaacttcgtgaagctgacggagctgtactacgccgggagccatggcatggacatccagggccccgccgcctgcaggcagcccaaccacgtccagcaggcaaatgtttccctctcacatgcatgatgcattgtcgatcgtaacccccttgactgactgaccttcaggtcgtacacacgcaggctgaagccgcagctgtccattaccaagctgcgagtgagttcctgccggtcatcgaagaggtaactaaactccatgcaactatatacgcaagcatctatatatatatccgtcgtcgatcgtccgtcttcatcagatcgtttatatattgccatgcaggtgttccgcacgctgacggccaagatggagtccatcgccggcgccagggtggagcacaacaagtactgcctgtccgtccacttccgctgcgtccgggaggaggtatatatatgtatagatcaattatattattctgtgccggccgggcctgttgatttctttttagttattattcatacacacgttggattcacctcggcaggaatggaatgccgtgaacgaggaggtcaggtcggtgctcagggagtacccgaacctcaagctcactcacggcagaaaggtgaggaggcatcgtacgtacgtatcgatcacatcagatgatatatatggatcggaataatattagtattatgctcagtcctgctgtatattagttccccgcctcccgatcgatcgatcgatcgatccagcagaatatcattgagcaactagtagtaccagtagtttattatactcactccgttcttttttatttattgcgttttagttcaaaaatgaacgacaaatattcgagaacggctcatatcttcgcaaaacaaaactttctttcagacaaaacatgacggtgcatgcagtagtgtgagcacgtacttaatttatttatgttttataatggaataagaaattgtatatactatatatatactagtaaaattagctaggttgcctattatcagcagtgagctagctagcaagacaaattaaagcagcaggtcggtggtggtggcggtggcgaccttgtcgtgttctcgctcgtcgtgctggtagctctagagagtacgacgtgcatgcatgcacaagcacaggggcgcagtgatagatggtgataatgcatgctcacgcacactagtgccttcttctcatatgcatatatgcaggtgctggagattcgtccgtccatcaagtgggacaagggcaaggccctcgagttcttgctcaagtctcttggtagatctctctctctctctctatctgcaaaccaaataaactatatgcgcacacacatatatggtgcacatgtatatatactagtattcttaaccatttgaacttttgttttttcaggctatgctgggcgcaacgacgtcttcccgatttacatcggagatgatcgcactgacgaggacgctttcaaggtaaaaaataaaaaaagaagctagcagaaaggtagatagtaggaaattaacttcgtgttggaaaatgaaaagagagaagctataggtgagctaataaactctcttgtcgccatgctgtaggtgctccgcaacatggggcagggcatcggaatcctggtgtccaagcttcctaaggagacggcggcatcctactcgctgagtgaccctgccgaggtaagaatctccacgtccgaaaacgataccggccggccgtctgtgtttgtctataggggatcggaacctcatcacttgtgacggtgactactgccaactagctaagctagaaagctagaccagtcacatctagacaatctttttcgttacccatgcatatgctttatttgttgttgggtaattgatgggtttgataatgattaactctcgcgagaccaaagctagctggttgttgacgtgcttgtggattaattattaaccgatcgtttttacgtacgtgtggtgttttatcatgacgtgtgtgtaggtcaaggagttcctccgcaagctggccaataagaagggggcgcgccaaccatgaaaatgaagacgacctcgtgcatgcatgtagctaagctaggcatggcgtggacgatggatggatggacgagcacaacagcaaagaggcgcttattagctacaactactggccttttttgttgttttctttttgctcctacctatgcatagatagtagtctctactctctactctctacctagcaacaacaacaacctagctgatgcgcgcatgcatgcatgcattggtcgtcgcttactacatgcatggccattcagtgcagtgcgtgtgtgcgatggcggagaaacaacctagctagctagctgctcgatcgatcgatcggccttgtcttggaagaaggcggcagggagggggtccctgtgtaactgctggggatccgatatatcgatctgtccttccggccggcaagatcttgtaattagccgctgtggtactagctagcagctagagagaaatggataacaaaacaaataacatgcgtcgtcgtcttcgtctccgttcattctcgtccctctggatcctagagcctgtatgtacatgcgtggtcagacgacggtcgatctgttggcaacgcgcgcagcagtctagctagctagtctgtgtgtgtgtgtgtgtaggtggtgggcacgcctgcctatgcacagatgacacgacgtacgtacacgtacacgtactgatgctgctggatcgatatcgcaattactttggttggtgcggcaaacctgaaaaccagcagtggggaggtggtggaaggaaaggaaccgaaagaacacgatgcacagtgcgtgcgcagtttggagtggaccagctctagccaggtggtagcggctgcttgcattgcttgttgtaaatgcagcatgcacctgtgtgtcagaagcatgcatgcgggagtcgtcggagtgagtcagcaggccggtcgatcggtcgccctgccggcacgagcgaggtagcctagccctgcgctgaatcatatctccagatagatagatagatagatagatagacagattgtattcaatgtagagtttgcaatgggtagctctgtggccggctacctatctatctatctatctatctaccagctgaagatatatagtatgattcagcacaatataatagcaacgacatacaccacgagagagagcgacaaaagtatttatcgtcagaaggcaggagaaaaaatatatttatctatcggatgatcaattaattgatcgtcatgaatagcgtggagccaaaagagatgtgggatatgctgcctgggagctagctaagcatgcatgcggtatgtaggggtacaagtccttggccagtagccgtgccacctttgccgcaggcaggcaggcaggcaggcgcagcgtcgggtcgggtcgggtactgtgggtgaaaacggcaaggatccatgcacatggccccctgcgcatgcgccggggacgccaacggtggcgcgcaggccggccgcggccgggcatgattga

SEQ ID NO: 526 - protein, 361 aa, Zea mays
MTKHAAYSSEDVVAAVAAPAPAGRHFTSFQALKGAPLDCKKHAAVDLSASGAAVVGGGPWFESMKASSPRRAADAEHGDWMEKHPSALAQFEPLLAAAKGKQIVMFLDYDGTLSPIVEDPDRAVMSEEMREAVRRVAEHFPTAIVSGRCRDKVLNFVKLTELYYAGSHGMDIQGPAACRQPNHVQQAEAAAVHYQAASEFLPVIEEVFRTLTAKMESIAGARVEHNKYCLSVHFRCVREEEWNAVNEEVRSVLREYPNLKLTHGRKVLEIRPSIKWDKGKALEFLLKSLGYAGRNDVFPIYIGDDRTDEDAFKVLRNMGQGIGILVSKLPKETAASYSLSDPAEVKEFLRKLANKKGARQP

SEQ ID NO: 527 - DNA, 4843 bp, Zea mays
ctttgagggcttgttcggttatttccaatccatatggattggaggggattgatacggattggagggtattttgacttactagggattgaaaccccttcagggcttgttcggttattttcaatccatatggattggagtggattgggagggattttgacttacaagggattaaaaccccctcaatccccctcaatccatatggattggggtagaaccgaacaagccctcgatccccctcaatccatatggattggggtaaaaccgaacaagccctgaagccgcgacagacccacagttaccatgtgtgcaaagtgtatagacactgcgctgatgtagctagcgtgtgtgacactgcgtgagcccataatcaataatcatacaggcagagaacatctgtagggctaaccctaattaagaatacaatctacttaatccccctcgtagctagggtatatatacaaataattaacgggtatggcagtgcatgcatgcatgccgatgacttgcactggtaccagttcgtcactaatgattgccaattatactgcggcccttttaattatgagatggaagcagcaggaggcaagctagttcaattgtccggtttgttaagccgcattgctcaagagcacccctgcctgcgccatcgatcgccacacggtgtgtgccagtctacatcgccggcctctttatcattgtgctagtagctgcttattaggcaaagctcaattacgcagctaagccagttgatatgcataaaagggaatgattactcttaaaccggacgcactggcgctttctgcttttttttaaaggaatgctatgaaaattggtacgtacgtagtactactactatgcatatcagtttttttcttcttcttttttttcttatacatatatcagtataccagtctgtatatatgtacacacacttcgttcttcagctacgacgtacaatactgctacaccccatgggctgcgggaactgttcgtgaaaagtgacgagatgaggcagcactgtggtagatattcttgcgagtagtggcaatgtcaccctcacacttttccttgtactgccattaatcccaatttgtccttatttatctgtttaccctctctttctctctcctcggccgggcccttttttttctttgcaacatacaccaccacaatattcttcaacactctcacctcctctcattcaatactgtctctcagcctttttttttcatagtgtgtgcggccgatctatgcacctcacctttcccttgctgcagttggaggaagtgtgctgcaggtggaagaagagaggggagaagctggttcccctctccatatctctcctccccagctccctccccctctcatagatcgatcacacagcctgcaggcacagacaagagttaggctgttctacctgatcatatgaccctccagcaattctctcatccacacacaaactgaagcaagaattattgcttatctatatcctgtctgtcctttcctctatttcccccctcccctttctatttccattgtgcagcttgttattagtagatagcagtggatcgatgtgtgatggaggaaacaagctagctagctagctaccagctgaagcagcagggagaagaaggatagagagagagagagagagagaaaacatcttcttcatccatagtctcggcctttcttcaccaggtcgtctgcagatctgtctcctgtgaccttccagaggtgaggatgagcaggtctctctagctcactgcgctacatgcccatgtatgagaagttctattttagaagacaaaaaggctttgatctgcagtcttcgttctcgtcttctgggttctggccttctcttgcttggcagtggcactattattatattatctatggttcttgagatttgagcaaataaagatcgcctttttttcctttaaaaaatctgtgcttcttgtgccgtatcatcatacatgcacacccacgcatttgtacagtggatcatgcatcctccatttgtgttcatgatcatgctgttgatttgcactgctccctttatcaataattttccgcagatgagaaatctacagtctcattattgtcccctctttctttgtcccaaggtaaaaagggaagaacagaacttccccatttttcccaaagattgcacatgcatagctggctggatcagagcacatcacactccgaaaccctaatcttctccctctcctcgtgcctttcccagaacaatatataatcctccgtccaagaaaaccctagccctaagattagtatcgaaagatcgcgatgcatattattcacagctcagccaccacaccaccatatgtagagatagatatacgtatatttctttgggaaaaaacggataataatccaactaattaatcaacgtttttctactgatttattcgcaggccaagctaggccaggaaggaaaaatggcgtccccgtcgagcaccagcaacaactcggccttctcccctgtggcggcgtcggccgggacgacgatgcctggtgccggggcgccgtgcgcggcgtgcaagttcctgcggcgcaagtgcctgccggggtgcgtgttcgcgccctacttcccgccggaggagccgcagaagttcgccaacgtgcacaaggtgttcggcgccagcaacgtgaccaagctgctgaacgagctgctgccgcaccagcgggaggacgccgtgagctcgctcgcctacgaggccgaggcgcgcgtcaaggaccccgtctacggctgcgtcggcgccatctccgtgctgcagcgccaggtccaccgcctccagaaggagctggacgccgcgcacgccgagctcctccgctacgcctgcggcgacgtcgccgccggcatccccaccgcgctccccgtcgtcagcgccgcccccaggctctccacggcgccaatgacgacgacgagccccggccagttcgccgccggcatgtacggcagcggcaggaggcttggggtcgtcgacggactagcagcgccaccgctgcctccgtcgggcggcggcggcggctgctacttcatgcggaaccaccacaacaacgtcgtcattagtagctccccaggcgctgacgtggcgcccgtcctgccttacgcttccgtggctaattgggcggtgaatgccatcagcgcgtcgacgaccaccacctccggatcagagagcattgggttggatcacaaggaagggggagacagcagcatgtgaagtgaaggggaagcgctgcgctgccgtgaatggtaaggcgctgtttctttctctctgagtaattaagtttaatcctgcacggcggccatgcccatgcatgatgtatagctactgtatgtgctagctagtttgtgtgttttaattatatacatatatagctgttcttatctgtgtgtgcgttgctttgcttattactatgcttgtgtagtgtgttgtgcagtgatgtattactctaatccttgttaagatgtggaggcgacgacatggatttgagccctttgaccttaatgagctgtgggatcggacggcggagtcggtgaaggaaggaaggaaggaagcttcaggggggggggggagacgatgtcatgggagcccaatcgatctcagcaggttgattaagagctaaggagcaatctatctatctatctatctacctacctttcgctatatatatctatatagccgacatgaattatatatatcgactgcatctatcccctttctgcatgttgtgcaaaccaatactttggagtactaaatgtaatcgagccgagatcttgatctctcttcttttcatgattaattcttcgttctcgcaggatccatccatccatcatcatcatcatcatcagtcattagcacactatgcatgcatgcatgctttggcctttgcgatcagaaaacaaaacagccacctttaggccttgataaataaaatacacaagagccaatcaaaggcagcaggttcctacatgcatgcatgagtagtagtgtagtactaagctgatctcttgggccaattaaagggctgcatgcatgatctgcatcttatatcatatgtcataggcaccagtggcctatgctcttgcatatatgctccagatatatgcatgatcgtcagatgggagatcgagctagctagctagggacgagaggggagagattaataacgacgagcacacagttattagttgtttaaactatattatatatacataaatactatacggtgatcaagcgagcatcacatcatttctttcgcagccagacattcttcccgtccatgttagtaaactgtaaaggcatggggggaaaagcagtattccgggcactattcttataggccccagatctttttatggatctcactgtttggtgcattgtacatgtatttattccatctctcgcgcgcgcctagaattttcctcccattggcattgagcccccttttttttctctaaatcctgcggctctgaattgttgcactggccgctgctttaacctgcatgcttaaatgttccatctgctgcacaagatctaagatgttcattgctgtgtactgttgggttccttagcttgtggatctcatcgagttttgcacttcctttttagttctgcccgtagtatatattgaagtgtgtgtacccttcttgcattgatgccactgttggtccccgtttaacctaaccatacctagttcgattccatgcattgctcgagtgagttttctatatataccaacagctgcatgatgatatagttactatcttgccacaagtagggccaccagtcatacgtacacattcacccttctaagt

SEQ ID NO: 528 - protein, 261 aa, Zea mays
MASPSSTSNNSAFSPVAASAGTTMPGAGAPCAACKFLRRKCLPGCVFAPYFPPEEPQKFANVHKVFGASNVTKLLNELLPHQREDAVSSLAYEAEARVKDPVYGCVGAISVLQRQVHRLQKELDAAHAELLRYACGDVAAGIPTALPVVSAAPRLSTAPMTTTSPGQFAAGMYGSGRRLGVVDGLAAPPLPPSGGGGGCYFMRNHHNNVVISSSPGADVAPVLPYASVANWAVNAISASTTTTSGSESIGLDHKEGGDSSM

SEQ ID NO: 529 - DNA, 3984 bp, Zea mays
catggtgtgaatgatcatgagcctaaatttaattcatctcctactaaaaatggtaatattaaagaacaaccaaattttattgagtgtttatattgatatgaatgttttaaatgtttcttaagtacttatattaatatttttatatattaaaaaataattgtatgggtttctatttaagccttgtcctgtgcctctaagatctcacggccgccactggtagtggatagctagaagcagcaatttgtgaacactgaaattttgtgtatgtatatatcatatatgaacggccctgatatataaaatgaaattctacgtgtacgtacacatacattcggtacggtagatagtctccagatacgcggaataatgattgagaaacgtgaaaaaggatgaacaacaagcatggggttagcttaggcatgcaacttcctatctagctgtgcctgtgcctgtgccgctgtgcgtgtgatcaaacgtcgcaactagcgcaacagcatcttctcacctcactcatttaaacatgctcgtccgtcgcaatcacggatcgatagctgtttcgtaccaagatcgtaagagataccgttgcgttgcgctgtagatcctccggccgcgccgcgtccctttcctccctccctcccttccctcccgtcaccaaccacggttgcttcaggggcggagcgatgatctgcatcattcattcatccggcccgagagcagagcgcacaccacaccacctccgtgaggtggagcggagccatcacctccgtcacgcacgcgatttcttttcaaaccgagtagctcgatcgagtcctcgttacgcaactcgaccaaccggcgtcggccagctgatcgagccgcccggccggccgcgcctggtgtgacgtgccatctcgatctcgatggggcatcttgctcctcctcgctctcttcttcttaatttgccgctgcgtgcggccttttattcgccctgcctctagctgctgcttcttccaggatcggggatcggagcttgtgctgctactgctactataccagcgctagctagcagcagccgccggccggctcgcgcaagctaaggaagggtcgacatgacgatggggctccgcgtccgcgactcctccgcgctgctggctctggccgtcgcgctcgcctgctgctccgttgcaggttcggttaccatatttcattcatctgaaaatgtaaacagtgtcgatcggtcgatgggcgacgctcacattctctcctctcctgtcgccatggctggcggctgctgcacacacactggcacttgcgcagtggtggcctacgaccccctggacccgaacggcaacatcaccatcaagtgggacgtgatctcgtggacgcccgacgggtacgtggcgatggtgacgatgagcaactaccagatgtaccggcacatcatggcgcccgggtggacgttggggtggtcgtgggccaagaaggaggtgatctggtccatcgtgggggcgcaggccacggagcagggggactgctccaagttcaagggcggcatcccgcactgctgcaagcgcaccccggccgtggtggacctcctcccgggggtgccctacaaccagcagatcgccaactgctgcaaggccggcgtggtgtcggcgtacgggcaggacccggcggggtccgtctccgcgttccaggtctccgtcggcctggccggtaccaccaacaagacggtgaagctgcccaggaacttcacgctcatggggcccgggctgggctacacctgcgggcccgccgccgtggtgccgtccaccgtgtactggacgcccgaccaccggcgccggacgcaggcgctcatgacgtggacggtgacctgcacctactcgcagcagctggcgtcccggtacccgtcctgctgcgtctccttctcctccttctacaacagcaccatcgtgccgtgcgcccggtgcgcgtgcggctgcggcggccacggcggccacgcgggtccgggcggctgcatcgagggggactccaagcgcgcgctgtcggccggggtgaacacgccgcgcaaggacggccaggcgctgctgcagtgcacgccgcacatgtgccccatccgggtgcactggcacgtcaagctcaactacaaggactactggcgcgccaagatcgccatcaccaactacaactacaggatgaactacacgcagtggacgctggtggcgcagcaccccaacctggacaacgtcaccgaggtcttcagcttccagtacaagccgctgcaaccatacgggagcatcagtgagtataatcatcgtcatctgatgacatgacatgacatgtacataatcatcggtgtctcaaatatatatatgcaattaatgcagatgacactggcatgttctacgggctcaagttctacaacgactttctcatggaggccggcccgttcggcaacgtgcagtcggaggtgctcatgcgcaaggacgcaaggaccttcaccttcagcatgggctgggcgttcccgcgcaagatctacttcaacggcgacgagtgcaagatgccgccgccggactcctacccctacctgcccaacgccgcgcccgtcgtcgcctcgcagctggtcctgtccgccgccgcctcggcgttcctactgttgctgctcctggtggcatgaccgtgaccgaaccaagggcaaggcctccgttttgttttcccgtctcgtcccgtgggcagggagcagacttcagtaggcagggcattttatttggtttttttgccaaggattcaacacttgggttttcgtcagaggaaaactgtcgtgtatgtagtgtgagttgcaggtcgtcggatccccacgtacaagacaatctttggatctagaatatgcaaaacgtgaatcagcacgccaggatcatcgtctcctacaagattggcagaaaaaaaatctcatgatgagtgatgtgtcaacagacctatatatatgtgataatcactggtttcaacggttgcctgaacatttgctaacccatcagtagccactactacatacgaagccgcaagaacagcgatgccgtccaaatagcgatgggcagaacgaaggatgagccattcgctcattcagtacaggggaagagtttaatagccatgagtacgcatctggtggagtcataactagatctcagcatgagccgtctgacttaacccgatttgacctactaaaaaaccctaacccaaccctactaatacaacgtgtgggatgagctatggtttttgacccataataatccacggactcgacgtaggcattttttactcaaagcacgacctaaccgaaaaaatccgacccaacataaaaaatccgatccgacacatccaacacggagacacaggccaacccgaccagacattagacatgagtcgtgtcgaacaacccaggatctaaccttgatccaaccagaatctggcccaactcaatgtttaaacaggtctaggcataaaactgctgccaccatgagtatatacaaccattctagaacacgaacgttggcgggaccttccggaacataagcgcaaatttcacattttccatctagcacatccagcatgagcaggtatgttggcacatttttggccaaacaccaactatccttagctcatgttcacggggaacgagaccttgagaatctctctgcgggagcgcggaccgtctctagtaggtcattggaccgcgactctgcgtagggagctccgctcttctatgtgggtgcgcggaccgtccgcgtggagatgatggaccatccgcaagggcacatagggcttcgtgaatctcctgcggaacctggatcttgcctttcgggagggatctcgtcggggaggaaagatcctagtgttgtcttggggacagtagaccaaccaagacgtctctagacgacgtcgagccaaaatgaggtgaagattgaggttggaaaactacaaccaaggctaaattactcctactcctag

SEQ ID NO: 530 - protein, 450 aa, Zea mays
MTMGLRVRDSSALLALAVALACCSVAVVAYDPLDPNGNITIKWDVISWTPDGYVAMVTMSNYQMYRHIMAPGWTLGWSWAKKEVIWSIVGAQATEQGDCSKFKGGIPHCCKRTPAVVDLLPGVPYNQQIANCCKAGVVSAYGQDPAGSVSAFQVSVGLAGTTNKTVKLPRNFTLMGPGLGYTCGPAAVVPSTVYWTPDHRRRTQALMTWTVTCTYSQQLASRYPSCCVSFSSFYNSTIVPCARCACGCGGHGGHAGPGGCIEGDSKRALSAGVNTPRKDGQALLQCTPHMCPIRVHWHVKLNYKDYWRAKIAITNYNYRMNYTQWTLVAQHPNLDNVTEVFSFQYKPLQPYGSINDTGMFYGLKFYNDFLMEAGPFGNVQSEVLMRKDARTFTFSMGWAFPRKIYFNGDECKMPPPDSYPYLPNAAPVVASQLVLSAAASAFLLLLLLVA

SEQ ID NO: 531 - DNA, 4295 bp, Zea mays
ggacaataatgtttcagttatcgagcacatgtgaaagtaaaatggttagctcgactcaagaaccgttagtggaaacaccttttacactaacggtttccttaaaaccccgatagtgcaaatcaagcattttcactgctgactttcttaagaaatcatatttgtaccggcagggccttaataaaggtcccgcaacttcggaagagacgggtgggtggggcgctcccatgattaaaatctgttttgctatttattttaaaacatggtttatatttccaaaaaaaattgtattgggggttttcttaacttaggcgccaataaaatttgatttccacggcagctgccaccgtcgtcatcgctgaccaacccggctggtcgcctctctgctccatccatgcacgttaccactatgcagatgcagccgaaacaaacactggctagaaaggcagcccaacgggcctactgtcattcgctccggcatcctactggtggtcccagttgcaccggccgatgaccagttcatcatttttctcgacgaatttgtgcacagaatttactaaaaattcttcgcacgtggcaaaaccggggaaaaatcgacaactagtcggggttttttttctgatagaatagtccctgctattcatccatgaaaaccaaacacgtacactacgtcaccgtcatggatggagccagtgaactgatgattttttccccaccccgcacgcaacagcatgggtgacaacaaccactcccgctgcggttgggcgagcacatctctacgcacttgacactcacgcaaacctaacgcatactagattaatcatcgccaccaactatcggcgacagaaacgatgggccccgcttctcttaatcacggtgcttgaattagtgcgcgcatagtagtgaaaaataatagtgaaaaataagcagtgcgtgttttggtgtggtggttggtgagccgtccggcccaataaaaacccctcgcaccacctcgtccctcttcgtcgcatcgcacgccatcagcagctagcgcgctcctcgagcccagcagagaaaggccggcctacccactctctctctctctctctccagtctccaccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccggcgaccccgccgccgcggcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacaaggtcctcatggagagctggtgagtagtagccgcatcgcatcaaccaccttctacctatctatatccatcacttgttgctgctggcgtgcgcggcatgcatgatgacgagctcgctcatcattggtgctactagtgatttatttcgtccagtaaaattaattaaggtgcgctgctactctactggctgcggctagcacaaggctggaaatagttgttacttgttatacacgatataatatttctctagaacaaaaaagattttttttttataaaaagcaagcaagaaagaaagtgagtgacttcatgtttttcctaaaaaaaagttaggagtgggatggaaaagtcagcaaggaccacttgtttgttgtccactatccatccagtgggtgagacttttttgcgagacggagcactatattattggccgagtcctttttctgtatccgcaaaacggcagccgtcgatcgccggacggatcgacggctcacatgagtgtcgagtccaattccaaccacgagggcggcaaggaaaaccatccgtgctggtctggactttttgccaaactccattcagccattcgccgactgaaggtgaatcttcagacagccagattgtttggtgtctagtgtgtgcgaagatggcgtagaaaagactgagagacagttggctcacacagacaagtgacaactgactatagtatctgcctgcctggctgatgctgatagagatggggactcttgtcctgtctgtttcttgtatgcgctgatctgattctgatcactgccactctgccaggtactatctcaaggacgcggtgctggacggcggcatcccgttcaacaaggcgtacgggatgacggcgttcgagtaccacggcacggactcgcgcttcaaccgcgtgttcaacgagggcatgaagaaccactcggtgatcatcaccaagaagctgctggacttctacacgggcttcgagggcgtgtcgacgctggtggacgtgggcggcggcgtgggcgccacgctgcacgccatcacgtcccgccacccgcacatctccggggtcaacttcgacctgccgcacgtcatctccgaggcgccgccgttccccggcgtgcgccacgtgggcggggacatgttcgcgtccgtgcccgccggcgacgccatcctcatgaagtggatcctccacgactggagcgacgcgcactgcgccacgctgctcaagaactgctacgacgcgctgccggaaaatggcaaggtcatcgtcgtcgagtgcgtgctgccggtcaacacggaggccacccccaaggcgcagggcgtcttccacgtcgacatgatcatgctcgcgcacaaccccggcggcaaggagcggtacgagcgcgagttccgcgagctcgcaaagggcgccggcttctccgggttcaaggccacctacatctacgccaacgcctgggccatcgagttcatcaagtgaaccaccgtcgccgcgatgagatggcatggctgccacatgctttgcttgcttggtcctcgtatcgtacgtcgccgtcgtcgtcttcttctggttattgcgctgctacctcgctgctctcgcgtatgcatgtacttttgcttaattttctttcttcatatcatgcactctggctggcctagactgcccccgatccatggtggccggtacgtcttgtcgagctcttgcatgtcgtggattctaaattcttcttctgcgtcgaattgtctctgccatgtgcgagtaataacaatcaaggttatacttacgatacaattacatggcggtttaattgctctctattaatttggtgaatcgaatcgattctactgaattcttctctgtcgtttaatgaaatttcctttgtcttttggattatataatataacacagacactcgatcacaaagacactcacaacgtgcgcacactcattcctataaacgcacacgcgcaaatcctactcctatcaagtatcaaaacttccaaagacttgaactggtcactaccggagaaaatggactttcgttcgaggacataattacttggataccgtttggttcacgaaatgtaacataaatggtaataataatgattcacacttaaataccggcggtaacaaatttgaataaggcgatatccatttgtagtgtggtatcaattacagctggatttaaacaaacatgatttaacgttatcggttacctattacgttaccaatatatgaaccaaacagcaccctgctttagaaccgataccaactcaatcatcagcatcactttttaactgttagtatcggtttgtgtcttcaataagtactaatgttaagtcattaacactggttgaatacaccaactgccgaagattgttcgacagtgaatatacgaggtatgtctatgaatgaaaacggacggaaacggttggaaaaatcactctcccatttccgtttccattttttatcaaaaacaggagcgggagcgatatagcaagaaatggaaaaggttgcgggatatacggttacacgaaaacggattaaaacgaacggatatgcaacgaaaatggatgctaatcggaaactttggctagaatatgcaatattttataatcactcagcgactacaatattaagagtttagaatactataaatcataacttcacaaatttaaaagtcgccacaaaaacatacgtttttttaaaaatcaacagcttgcgcaaatgcaacacttttttcgtcaacgttcttcaatcatcaaccccaaacttgtaga

SEQ ID NO: 532 - protein, 364 aa, Zea mays
MGSTAGDVAAVVDEEACMYAMQLASSSILPMTLKNAIELGLLEVLQKEAGGGKAALAPEEVVARMPAAPGDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDSRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 533 - DNA, 3480 bp, Zea mays
acttttagtacttgttcttggcttgaacctgttggtgttttcaaccgcactaagggcttgttcgtttttgcgttaatccatgtggattgggtgggattgagtcggattaaatccatagcaaatcaaaatccatcccaatcccacccaatacacttcaatccacatggaatatcaataaccgaacaaggcctaaagagttgaaattcattactggttcgttactagaagtctagaaccagtactgatgatatctgtgcatatttagtactggttagtgtctccaaccggtactaaagacttaatattactagcacttgatgagggacactaataagtactaatgtactctatatggactccggtctgcatttaaaatcggtgttgatgcctatatgaatatgggttttaaaacaactcgaataaggggatgtttggtttctagggactaatgtttagtccctatattttattccattttagttccaaaattgctaaatatagaaactaaaactttattttagtttctatatttagcaatttatagactaaaaaggaataaaatgaagggactaaacattagtccctagaaaccaaacaccccctaaatgttgatgtaggaagcctagttctcttgccgtggcgtttacagaaaaaaaaagactaaagtaaagtagcattctccattatcggtcgaatttagaagagaatgtgcagactcatttatcgctgtttgctaagattgggatctcaatcatattcgtttccgttccaagcagcttttgccccggccgtttggctgcaaccttgcagggctcacatgaaatccctcagcatcctgctgcatatcatttgctaccttcatggcttcagtccacacttcacacctgcaggcttgtagctagctggattctcacacactccccagctcccacacgtcctccgatccgatccgatcccgatcctccagaagaggggcgagctgcaagcgtagggcggcagcatgatgcactcgcaccaccctcactaccatccgcgtttccacccgccgtcgtcctcctcgtctgaggcggtggacatggacccccgcgtgtggagccggctgccgcagccgctggtggaccgcgtgctggcgtgcctaccgacgccatccttcctccgtctccgggccgcctgccgccgcttcggcaacctcatctactcgtcgccgttcctccactcccacctcctcctctcgccgcacctccccttcttcgccttcgccgtcccttccgcggggtacccgtacctcctcctgctcgaccccaccacgcaggcgcccgcgccctcctggtcccgcctcccgctgccgctgccggccgcgcccggcgccgtgcaggcggcgttctccccggcggccgcgtcggcgggcctgctcgcgttcctgtcggacgcgtccggccacaagacgctgctcctcgccaaccccatcacgcgcctcctcgcgccgctgccgctctgccccaccgcgcgcctctcccccaccgtcggcctcgccgcgggacccacctccttcatcgccgtcgttgccggcgacgacctcgtgtcccccttcgcggtcaagaacatctccgcggacacgttcgtcgccgacgccgcctccgtcccgccctccggtttctgggcctcgagttccatcctgccccgcctctcctccctcgacccccgcgccggcatggctttcgcctctggaaggtagttaaaggctgatgaagcgcacgcacgtgtgtgcgggattattatttgtccatgcatacattatacataacatacacacgagcatacggcagtggcatgagattgagatgaatcaaactaagctgactacagcatgcaagttccactactgcttcacttgttgcaggttctactgcatgagctcgtcgccgttcgcggtgcttgtgttcgacgtggcaaccaacgtgtggagcaaggtgcagccgccgatgaggaggttcctgcggtcgccggcgctcgtggagctcggcggcgggagggagcgcgaggcggtggtggcgctggtctccgccgtcgaaaagagccgcctcagcgtgccgcggagcgtgcgcgtgtggacgctgcgaggcgagcacggagctgctgccggcggaagcaacggcggcggagcgtggactgaggtggcgcggatgccacccgacgtgcacgcgcagttcgcggcggccgagggcgggcgcgggttcgagtgcgcggcgcacggcgacttcgtggtgctggcgccacgcgggcccgcgagccccgtgctcgtgttcgactcgcgccacgacgagtggcggtgggcgccgccgtgcccgtacccgtacccgtacgccgcgggaggcgcggggttcagggtgttcgcctacgagccccgccttgcgacgccggccatcggtctcctggacgccacggcgccggcggcctttttgcatgggatgcagggctagctaggtgctaggctcaggcgctcagctcattgacgtgtacgcatcatctacgtaacggaaatcgttccggtctctgcgttgtgaggtgcaccatgaaatctggtgtttttcttgagcgtctgttagcgaaggctgctggtaagaactctactactggtctgaggcgtgtctttaatatattagtactattaagtatctcatgataatttatgtgtacggggccggattattagttatatgaacatttaaacttgctttctgcataagtatttgcaatctaaaatggaccatgcatgcaagagtgaagtcttgtctgcagagagatctggtttttggtgtgtgtggtttcttttctgtgtggccagtggcttgtaggccaatgaatttgctggtgctgctcccgttcgatcatatatatgcctattttatctcttgtcttgaaaatcatctgatgaagttagttcacgcacatcatcttatgaagtgcatgatttcacccatttctgcgccttatgaagtgtgtttttttttctcaaggcatttcgcccattcacatatggatcacactgtagtttaaaagaccatgcaatattatcatatataggccaaaaactcatacatgagccaagacaagatgctgaagagagctaaatcaagtgctccattatctcttttaatcgaatccaggatctgctggaaaagggaacgcgattttattctaagatagttttaatttatgtcaatatgatcttttcttttcttttattggagggatatgttgtgggatggaattgtttcatcctagtttttcaaggctttagtactaggataaggggtgggaagtggctcctatatacaagaatattcttctagatgtttgacaagccaatcctaaaaacttactgtggcattgttatccctcttgcaatgtgatcagggcaatgaatctgagatcctaaaataagatggagccattaggccccctttggaacataggact

SEQ ID NO: 534 - protein, 436 aa, Zea mays
MMHSHHPHYHPRFHPPSSSSSEAVDMDPRVWSRLPQPLVDRVLACLPTPSFLRLRAACRRFGNLIYSSPFLHSHLLLSPHLPFFAFAVPSAGYPYLLLLDPTTQAPAPSWSRLPLPLPAAPGAVQAAFSPAAASAGLLAFLSDASGHKTLLLANPITRLLAPLPLCPTARLSPTVGLAAGPTSFIAVVAGDDLVSPFAVKNISADTFVADAASVPPSGFWASSSILPRLSSLDPRAGMAFASGRFYCMSSSPFAVLVFDVATNVWSKVQPPMRRFLRSPALVELGGGREREAVVALVSAVEKSRLSVPRSVRVWTLRGEHGAAAGGSNGGGAWTEVARMPPDVHAQFAAAEGGRGFECAAHGDFVVLAPRGPASPVLVFDSRHDEWRWAPPCPYPYPYAAGGAGFRVFAYEPRLATPAIGLLDATAPAAFLHGMQG

SEQ ID NO: 535 - DNA, 3432 bp, Zea mays
ctgacaatgcattgtaaatccagccgttgatgtgaagtaacagaccgtcgaacgtaaggttatttttttaccctttagaaccaacagacatttgtcgtcggatataaatcttaagtcgtcgcacataatctatgtccaacgtcgtggacttcgtaatgttatggctttactgttgtgagtcgttgatggctgttttgctttagatttgtacctcgggtcatattcgattccgttccaatcaacttctgtgcccggttgactacaactaggggtggacgttcgggttactcgaaaattttggatcggataattcgggtatctaaaatttcgggttttgacaatcgatacccaaaattacaacgggttttacaatacccaaaaattcgggtacccggaatttcgggttcaagatcgggtattcccgaactgttgtgtcagcttcataaaaataatgcaccctatcaaattagtataaaaatatagtttgaataatgatatacatagacataaaaacataagcaatctacgatctcaagtcatgcacacttatacataattatagatgcacaaattaataattaagtatgacatgcgtacatgacacatgaaagttcggataattcggatataccctattataataaccgaattacccgaaataaattcgggttttgcaagtttctacctgaaattcccgaacaaaatttaggttttggatatttcaggtattccatattcaggtatttcgggttacggaatttttacccagccctatctacaactgcaatcttgccggcctcagatgaaatccctcagcggcatgccccatatcatctgttacttccttcctctagctagttctagctacttcgtggcttcaacccaaacttcacagttcacaccagcagagttgtggtagttcccagttcccggcccacgtactctagtaatccgatccggatccccccagaagaggagcgagcgtagggcaacaagcaacatgatgcaccagcaccaccctcaccaccttccgcgcttccactcgccgttgtcctcctcatctgaggcggtggacatggatccccgcgtgtggggccggctgccgcagccgctggtggatcgcgtgctggcgtgcctaccgacgccgtccttcctccgcctccgggccacctgccgccgcttctgcagcctcatctactcgtcgccgttcctccattcccacctcctcctctccccgcacctccccttcttcgccttcgcggtcccttctgcggggtacctcctcctgctcgaccccaccaggcaggcgccttcctggtcccgcctcccgctgccgctgcccgctcccggcgctggccaagggttctccccggcggccgcgtcggcgggcctgctggcgttcctgtcggacgcgtccggccacaagacgctgctcctcgccaaccccatcacgcgcctcctcgcgccgctgccgctctgccccacagcgcgcctctctcccactgtcggcctcgccgcgggacccacctctttcatcgccgtcattgccggcgatgaccttgtgtcccccttcgcggtcaagaacatctccgcggacacattcgtcgccgatgccgcctccgtcccgccctccggtttctgggccccaagttccatcctgccccgcctctcctccctcgacccccgcgccggcatggctttcgcgtccggaaggtgaagtcgcaagtctcaactctcaagtgcacgtgtgtgcagaatgtgtaacactatgcatacacatgagcacacggcatgagatcaaactgattacatgtaagttctactggtttatttactgttgcaggttctactgcatgagctcgtcgccgttcgcggtgcttgtgttcgacgtggcggccaacgtctggagcaaggtgcagccgccgatgaggaggttcctgcggtcgccggcgctcgtggagttcggcggcgggagggagcgcgaggcgagggtggcgctggtctccgccgtcgagaagagccgcctcagcgtgccacggagcgtgcgcatgtggacgctgcgcggcggagggcacggagtcgccggcggaagcagcggcagcggggcgtggaccgaagtggcgcggatgccagctgacgtgcacgcgcattttgcggcggccgagggcgggcgcgggttcgagtgcgcagcgcacggcgacttcgtggtgctggcgccacgcgggcccgcgagccccgtgctcgtgttcgactcgcgccgcgacgagtggcgctgggcgccgccgtgcccgtataatccgtacgtcggggggatcgccgcgggaggcccggggttcagggtgttcgcttacgaaccccgcctggctacgccggccatcggtctcctggatgccacggcgccggcggcgtttttgcatgggatgcagggctagcttggtgctagctagctcgtcgatcatcaatcgtttaattactggttccctgcatgcattttctagatagtgggtcgaaatcattcgggtttgatctgcgttgtgaggtgaacaacatgaaatttggtgttttcctgtgaaggcctgaaggctactggtaagtccgctagtttgaggcgtctgtctttgtgaaagcctctttcgtatatgttccttagcactattaagtatgtggtatttcatgattcatgtatggggataactatatgaacatttaaacttggtttcttcgcataagtatttgcaatccagaataaaccatgcaagagcgatgtcttgtctgctgactccattctggcttgtggagagtggttttgtgtggacacagtgatactactactctaatttgctgggtgctgctgacctttcgatcaagaactcatgtgcgcctattttatctcttgtcctgtcatatgagatcatctgatgaaattcatacgtactccagcgcagcaagggtgttttcgtaaggtatgctacaaggatatgtttttctcaaggcatttctcccattcatcacatatggaccatactgtaggtcaaaagagaatgcaatgttatcataggccaaaaattcatacatgatgagtctatcctacaagctgctgtcacacttcataatatctttcttttaatcgaatccagtatatatccatatagtatcatgtgtgcttgtttttttttataaaaggaagttatttgattacgctcttgtatatgttttacttgaaaatatttactttcagtagatatgaatcttggctgtaagattgaagaaagaagcgatgaaccgatgagtgtctgggaattgagctgttttggttagttttgatggattcagtcccaatcagttaacaatatatcaaaggtttttcttttgtaaactaggtccactttagtgccatctcatgaattacatgatttctcatttatggtagtg

SEQ ID NO: 536 - protein, 433 aa, Zea mays
MMHQHHPHHLPRFHSPLSSSSEAVDMDPRVWGRLPQPLVDRVLACLPTPSFLRLRATCRRFCSLIYSSPFLHSHLLLSPHLPFFAFAVPSAGYLLLLDPTRQAPSWSRLPLPLPAPGAGQGFSPAAASAGLLAFLSDASGHKTLLLANPITRLLAPLPLCPTARLSPTVGLAAGPTSFIAVIAGDDLVSPFAVKNISADTFVADAASVPPSGFWAPSSILPRLSSLDPRAGMAFASGRFYCMSSSPFAVLVFDVAANVWSKVQPPMRRFLRSPALVEFGGGREREARVALVSAVEKSRLSVPRSVRMWTLRGGGHGVAGGSSGSGAWTEVARMPADVHAHFAAAEGGRGFECAAHGDFVVLAPRGPASPVLVFDSRRDEWRWAPPCPYNPYVGGIAAGGPGFRVFAYEPRLATPAIGLLDATAPAAFLHGMQG

SEQ ID NO: 537 - DNA, 6325 bp, Zea mays
caattacatgttaaaatagaggcatcgatacaattgtaccttttatatagcagcatgcgccctgttgggatacaattgtacctttcacatgtcttctagatggttcccaaccctttggccaagatcgtacagataatattgcgaggagcccaaatcaacggtgtccatatgttatgttgatgtggatggtttacctaggcgcaaaagtgcgctggtttcgtccgtacaaatatactttaagtatggttttgatttttttctatttttcattttttaaataaaacgagacaatcaaatctgatataaaaatcaaatgaattataaatagagacggaaagagtatatatatttgttttgctattatttaaagtattaaaagatagtggacgaatgaacgtcctctatgtttaaaagaacgttttagaggacgttgtgttgttgaaggaaatatgaaaaaaaaatcttctgcatatttagaagggaggagcgtttacacattactttcgggacttcaacccaaatatgtcaaggtttgtgagtggctcagtgcggaaaaaaaatcctatatataccagatgtaaacactatcttttacagcctatcacattcacatttagaggttcacaaagatagatcaaaatttataaaataatcatttaatattttttttattttatttatatggataagcagctggtgtatgtgaggagctgtaaaagatattttttacatccgagatgtaaagattttttttaactcaatgctggttaccggctgggaggacgatgataaagaaagcatctctcactgcattccgggcccactactcaaacgttcggcacgccaggttggcaggtagccgttacatcgataggcactcggccactcgcacgcagacaccacaccagtgtgctcagtgctcactgctcaccataataacgctgcacctcttttcatttcaccatctcctgcccccttaaaaaaaagactcaccgtcgacacgccctcccgtcccgagagttctgaatcgaaaccgtcggccacgagagcagtgcgaggcgcccaccgcgatggctcgaaccaagcaccaggccgtgaggaagacggcggagaagcccaagaagaagctccagttcgagcgctcaggtaacccgggtcccgcgctcccccccgcttcgcaagcagacgctgtcgcttctctccgaccctggtgctaagcacgttccttgttccgtcttttgcaggtggtgcgagtacctcggcgacgccggtgagcgcgtgcgtgcggggatcagttccctccttttgcctttttttgttgggctgctcttacttgcttgcaagctgtttgatggaatgcaggaaagggctgctgggaccgggggaagagcggcgtctggaggtgactcaggtgaggacctatttgtcgttgctggatgctgggtttcgcttgcaatctaattttgttgcaagatgagggcgaatgtgccagttccatgtgggtgtcatggtctcggagttactaccttaattgctcaccatagtatgttttcttaaaaaaaacagttaagaagacgaaaccacgccaccgctggcggccagggactgtagcgctgcgggagatcaggaagtaccagaagtccactgaaccgctcatcccctttgcgcctttcgtccgtgtggtgggtgcaggcgtgtttgtcctctgcatagtatggggttgttccgcattctgtctaatggaaagttattcttctgagaaaaaaaatgcaggtgagggagttaaccaatttcgtaacaaacgggaaagtagagcgctataccgcagaagccctccttgcgctgcaagaggtcagttatgaaaaatgtcttatctctctgttaagatcctcttcatatacatagttgctattgctatcgtgaagtcttttttttctgttaattggtctggtactacttactagtcaggatttcatattgcggtttttcctagtggtgtgtagttaaaaagtagtttaattgcttttagttaaaaggggtgttcagggctaaagatcaactatgagaaaacagaaattttcccaattcgatacccgacagcattatggcctgcgctaatggaggtgtttccgggcaaatactctagcctacctgggaagtaccttgggttgccccttcatttcaggaaagtaaaaaggaatgatcttcaacctctaatcgaaaaaatcaacaacaggctggccttgctggaaaggcaagatgttgtccaaggctggtatagaaactcttgtaaaatcgatgctatccgcacaaccaatctaccatctaatggtttttccacctcaaaaatggctgctgcaaacaattgacaaaatacgaagaaacttcctgtggagagggagcaatccagaagtttgcagcgggggtcactgcctcgtcaactggcccgtaacttgcctcccaaagaacaagggaggtcttggaattctggaccttgatcgttttgcgagggggctaagactaagatggctgtggctacgatggaagagcaaagatagggcgtggactgccttgaagcttccttgtgacaaaactgatgaagatctcttcaatgcttccacaactgtcacggtaggcaatggaaagatagctgaattctggaattctagttggatccaaggccaagcccctaagaacattgcgccaacactgttcaagaaggaaaagaggaagaacatcacggtcgccaaagcgctcactaacaacaattggattcgtttatgctcaccatacacgggtgagggggagtttagagaggtcgtctctctttggcaggccataggtaacatgcaagagcttaacggtttggaagacaacatctcttggagatggacggcagatgggcagtacagtgctagcagtgcatacaaaatccagttcgcatccaatttcactaaaatgaacctctgccctatttggaaggctaaagtggaaccgaaatgccgattttttgcttggacactacttcataagagaattctgactgccgataaccttcataaaagaggttgcaactcagcctcagaaacaattccccacttatgcaaggattgcccctttagtagagaggtgtggaacaaagttttgtctcgggccaactttcctttactgactgggtctcccagtgacacttctttgtatgattggtggacggacatgtgcagcctttgcagcagacaggcaagaagaggtttcgacggtctgctatttcacttttggtggaacttatggctggaaagaaataacagaatctttcaaaggcagcgtagaagtgtagatcaagttgctctggcagtcaaggattatgctagtagctgaagtctagttggtttggactagtggttttgttgcttttctttttaatttctttttagttctttttatgttgttttcgtttccttaagttgcttggagtctgtattatcctctttcttctaatatagatcggagcgacaaaccttttgccccttcctttcaaaaaaaagttaaaagggaatttaactgctttcctagtggtgtagttaaaatggatttcatattgcggcctttcctagcttgcttgctattgattggactatagtgatccaaatgctgataactttgtcgcttgtgtaggcatggttagagagcttagagtttgcatttattcaataccttgagactgcatttcatatacataaattattcatgattatttcttttctctatttgttctggttaattaagagttttaggtttccatatttttgtacgtgcatcatttaaattcttgtattgtttttcgttcttgtctacaggcagcagaattccacttgatagaactgtttgaaatggcgaatctgtgtgccatccatgccaagcgtgtcacaatcagtaagttatcactgagtgaactcctttttctctgtagcattactcctaatgaatatgtgtgatgcattttggttgcacgattctttagtgattctgcttcagatggatatgataaatctagatgttattttgaagtggcgaattgcttacgagcggaaatagtaatgttcaaatagcgcaaagtgcaactgttgacttttagtaggccatttatatggtttgattaccaacaaatacgtcaatcatatgatttgattatcaacaaaggaatcagctatatggtttgattatcaacaaaggaatcagctaggtttgcttatcaacattcaacaaaggcatcaagtaatactccatccgtttcaatttataattcgtttgactttttttatctaagtttgatcggctcgacttattaaaaaaaatcataattattgttaatttttgttgtgatattgtttagtataatatactttaaatgtgactttgagtttttcattttttcgcaaaaaaaaatgaataggacgagccggtcaaacgtgacacaaaaaagtcaaacgaattataatttgggacacacggagtagtaaataatgtaacaacttagagagtgggacaaaaaaatctctagtggtgctaaatttagttcagctttgtataaacacaagcattgattgagaaatctgacaactcaaggatctgtaggaaatgtgttaccctaaatgttttccttactgatgcagtgcaaaaggacatacaacttgcaaggcgtatcggaggaaggcgttgggcatgatatataatatccattctgattgcatcattcttgtgaatttgtttgtaggagctagacattagtgttgttgaatgctgcatggttcctaatccttttcgcagtctaacatctgtggagttagtatgttacatggcaacagctgaacatctgtggactatatggcaacagccgaagattgtgtctgtgggataactggttgttttggttgctcttcagtagtttgtttgcttcaggtaaccatgctgcgaactatgatgttttcattctcggtttgcttcagctaaccgagatcgattcagtctgcagtatggactatggagtaaactgcatgctgaaacccgaaccactgctgaaactgcatgctgaaacccgaaccactgctacggcagttgccaggatagcaggagggcctttatgcacagtggaattgagtagagaactgagtaaaccatggttctttctccttttgaactggaacacacacagttggatcttgtttctcttcttaggccattcatcgtgtttattaggggtgtaaatggtacaaatattatctgtccgtattcgaatttgatctatctaagaaggttgaaatccgatccgtattcgagtccacgtattcagtacccgatccgtatctgaattatattcgtacccatatattcaaagttggatatttaagatgtcgataccaattctaatcttatctgtcataactcgataatatctgtatccgattcgaatccgaagagaaaatatgaaaacaaatatgtacaagcaatacttgtctgtatctaatttgattataccactagtgtttataaacatgtaaaatattgttttttgttttgtacagttttatactataaaattaaagagtgaagtttaaaatataagacgagaataattaagcaccctatatgcgttgatgaaccacttaaataattaagcaccgcctgtgatccaagcccgcacccacagggtcacagagaacttgggaagagaatggatcacctagtcaccggggcgcggccttgcgatctctgtaaccactcctctaagactttgtttttggttgaggagccaagtagaacggagccgttccatttctaattctaagaacgaagccactctgttctgtatttggtaagctggaacggagcgactctgttttttttgtttggttgcagagtgaactggaacaaagcggctctattttttgtttggttgcagagggagacgcgcgagctgctgcgcatggatgggagggcgagctgtgtgagcgggctgggaacggagcggctccgtcccattaatttttttggagtgagatggtttcgaatctaaggagaatattcactaattggagtcactccgttctggctactttgtaaccaaacaacaacaaaactgagacagaacgactccgttctacttggatctttaactaaacactacctaaattcttcattagaactcctcaatccggctgagctcttggtcggtgcgaactcgcctcaatgcttgcagtgtttctgcgcgcttttggcgatcgatttgtctgctaggtctagcggaaggtcacttctaagagcatct

SEQ ID NO: 538 - protein, 157 aa, Zea mays
MARTKHQAVRKTAEKPKKKLQFERSGGASTSATPERAAGTGGRAASGGDSVKKTKPRHRWRPGTVALREIRKYQKSTEPLIPFAPFVRVVRELTNFVTNGKVERYTAEALLALQEAAEFHLIELFEMANLCAIHAKRVTIMQKDIQLARRIGGRRWA

SEQ ID NO: 539 - DNA, 8816 bp, Zea mays
ggtaatctttgagctgaaggtcctcctgggagaaggtgattgggatgtgagaccatttggacttgatgaagggtccctgcacctcaacatgctgcaccgttctctgcgcttccttcttctgcttcttgttagccggctctgaacttgaaccgcctattatcgggagcaccagcttcgtagccgaaggtgctacgacttggttgttgaacgaagccatcagctcaaaagtggaagtgagttcaccggaggtggggcgccaatgttgggggacttgttctcaaattctatgagttaagaataaggcaacacaaaagaggttaatagttaatgcccttcgtccttcgaagcattatttcccttagggtataacgatcttcggacgaaggttatgaaggacataccttcatcatcacagtatatgttaatgaaagaagaagcatataaaatatgagaaataatataaataatcatatgccatcattaatatatctttattatatcatcatggatgaataagaacaatattgaattacatttgtaccttcgacttaacagaagacaaaagtacaagcgtgacgtacgagcgaatacaagccagcgtgaacagtatgggagtactgttcacctatttataggcacgagacgcagcccgatcaaaattaaatttatgtcctcgacaactagttacaatcatgacacaaattatcgtggaccgattggtcttttcctctttaagtcggtgcagctcttcgtctcaaggtatgtcgctatgtcgaagctccctggatggtagcttcagcatgcaccttcgcgttgtatttgcttatgtgctgatatttcgaaggtgtttatttttaaagaagcttcggcgacgaagcagaccccaataacgatagcccaatacaattctatttaaaaccaatcgaactatgcttacttagatccacgaacggacagtgcccgctcgattaaattggtacgatccataacgagtcgggccgtgtcggtacggacggcccattagccacgtagagtcgacccgccgccccgttgtagccccggtcccacctcgcacgccctcaggcctcgacatccactgccttccgttcgtctcaatcccccgtcgcattccgcaacacctgctcctcgcccccttctctcagaggcgacgcctcgggcgctcctaccctgccccgtctccggtccccccgcgccgtcggcgaggcagccggccgtcacagaagcccgatccggaccccgcgaggtcagttgagatccctcttcttcctgctcctcctcccgccgctagatctgctcacctcaccacaccgattggccacttccgatcgccgcgccggtcctcgacaccgccgccgctgccgtcgtcgttctggagttcgggcctccttcgctcgcgcgtctacgcgtggctcccatgccagatctgttttttttctggtcgattgcctagttttggaatggttgccctgttttgagttctcttctcacggaacggtttggatgctgtgtggtgttggtggctaggtacgttggtaactagttatctggatcaatcattgctcgtgctgtgttgtagatgagtagatcgcgtctgcgtctgttgtccatatcgttgtgtgcgtgggcccctcgtctcgtcatatcgagattcgctcgtttattcaggtgctgcgagcatgcaattttgtagttgatatgtcgctacataaatcagattttagaaacaacatccaggtaaaaattttatcccgggaattttctccacgcctcctgagtgagaagaagaggcagccaaagaaggccgaaggctataaataaacactcttggtgtctgggcaccaaatgactagatttattcatgccaaattttactttcgtggagcatttgtctccactcgattcaattcctcagaatgtttagatgcctagtgatgatgtttctttcctgaaatcacatttacaggcaatataaataggagcctttgtgtggaatcttttccgggatcaatcaattataatcgtttgaactgaagcccatgccatttttatttgggtagttgagactcacagtagcattcaacatgccagcatgaattagttaattttatttggatcacatattcacatgtatcacagagtcagtagtattcttgtgttcttcaagcaagtcaacccagagagcttttagtcataaatttgcagtggtttggttcatctattctttggttatgcgccatcagagatctgtttttgtatattctatccaaatgttcctttctaatttgcttctatatgtttatgcaaccaaaagttttgttaaacttattctattttattttcttaggattttttatatagttacaaagctcttaatattgtttcctcatttatcaattcagaaatccttgttatacctgatggctatgattgatgagcctctttatccaattgctgtactgattgacgagctcaagaatgaagacatccagttgcgtctaaactccattagaagactttcaacaattgcacgggctcttggagaagaaagaaccaggaaggagctgattccttttcttagtgaaaacaacgatgatgaagacgaggtgcttcttgcaatggctgaggaattgggtgtgttcattccgtatgttggtggtgtagaacatgctcatgttttgctcccacctttggagacattgtgtacagtggaggaaacttgtgtccgtgataaagcagttgaatctctgtgccgtattggtgcacaaatgaaggaaactgacattgtcgactggttcattccagtagtaaaggtaagaggttcatttatagaaagtatttggtgtaatgttattgtaaataaatattccgccattgttactgcatttagtatttgttgatgtgcttttgttggctcaaacaataaaaactgtatttcatgtcatatgcactatttatctaattttcctttaccttacttggctagttcactgcttagatgtggcaattattttctccacttcccatgctttagtaatttaatgtgttgtactgataggcctcttcattttgttagatgtagttggcagtcagctacgctacatgggtcagatcggccgtgttagcgtggtgtgtgtgaatcaccactgtaatgggcccatcccagcccatgtacttatctatttataatacagccccctacacaattagggttaatgtttccaatctaacaggcaatatgagaggctaattgggtttatgattagagatacgattgccacctttcttaggcatcaggtaagcctctatataagaatatgagatgtatgaatcaaaggcaatcaagaattatcttagagaccctcgtctactcttgggccttgagattgggcatcaccatccttggcgtgctaaatatcagtgtttggtttggcatccattcactctcgtaccgtcaacccctgtgttctgcacatctccataatccaggactagcaaagtgcccttacattgctacgatttccatttatacttgagtagagaataaaagcacaaaaacatgtgttctgttggccaggtaggtgtgagtgtcggtttggagcaaacaatcatggtccgaatccccatttgtacataattttagctttttaatatttaaatgtgggggaccacgatgactgtgggaactggtgctttatatagtagatagatagagatgcgttacactcgagtactcgaccaaatagctgttgagtcaagcagcatttttctacatgcagtcattgttttgctttctttaccatgtgcactgtcaactgatactctaatatttctctgttgtagctttgcatttgcttgaacttcaaatgacattataatatgcaaaacattgattggttaagatgcatggttttctgagtatagcatctcctgctatggtaccatacgatgccatactacatgccttttcatacgactacagttttaccaattcatttgtttaaccttcagtgtttattattagaaatacttgtgcatgttatttcatgttatgttctactagtacttacaagtccatccatcaattttaaactatccatgttttactctgttcagaggctagcagctggagagtggtttacagctcgcgtatcgtcctgtggtcttttccacatagcctatccaagtgcgtcggaccaattgaaaacagaattgaggactatctatggtcagctatgtcaggatgacatgcctatggtcagaagagcagcagcatcaaatcttggaaagtttgcagctacagttgaacagaatcatttgaagacagaaataatgtcaatatttgatgatttaacccaagatggtacattctatatacagtttcaatgaaatgtgttgtgttcctccgtttgtttcttgcttcttgcactgattattccctgttatttgtcctttttttcgagataactgattgtgtatcatttttctctaaatagtttcccctatgcttctctgattatcattggggcctgaaatttgaaagaaaattttaaatatttttctctttcatggcaaaaaagtcttacaaatttgaaatcttttttcgtgatgctcgaatatctttgtcagggcctaaggaggattagacaaggatagacaaggattagacaagtatagttagagataagattagaagattagttgagattatctaggaaggttatcggttagtatttgttgagagtttttaggagagttttgaggagatgaggatctctagctagataggggcggccagctggcctatttatgtaatcaatggatgggaaataaagtaggcaagaattagaagggagaaacccccctcttgctcggccgtgggcagaggcccccagccgacgttcctgtccatcgacacccctctccaatccctcaccgatctagcgaccataacaatcttaaagccagaattttctctgaaaagcgcactacagcaggcctaaaatatacatgtgttttggaacaatttattcatgattgaatttgaatcattgggttagtgtttgcatatagtcatacgcatttgggacatcattaggactatgtctaaacctgctggtctttattttcagatcaagattcagtgcgtctgttggctgttgaaggctgtgctgcccttggtaaattgttggaaccacaagattgcgtagcacacattcttccagtcattgtcaatttctcccaggtacattgctcccatgttggacccatacatcctgcagcaagtaatttgctttctttgtctggaaatattattccccagaccccacccgtgggagcttccagcactgggtctgccctttttgtcttgatatattattggaagacatgtttgtagttgctagaggttgataatttcttagttttgcaacttgttgcagttaagtgcatcaccactaacaaatgctacttgcttgtactcttttgtttaggataaatcatggcgtgttcgttatatggttgccaatcaattatatgagctctgtgaggctgttggccctgagcctacaaggtattatttgtcctagctgaattcaacctattattgcagggaaaccatgtgtctgaattcttgagtatcatgtaaacccatagccttttcaaatggattaactgtaaatctctgcttttgggattagagctgatttggtgcctgcctatgttcgcctccttcgtgataatgaggctgaagtgcggatagcagctgctggaaaagtaactaagttttgccgcatattaaatcctcagctctcagtccaacatattcttccatgcgttaaggtgggggcaaagcaattattgaacaccatttcgttgctatttttcttctgagtgaattaactcatgccaagtgcatctacaggaattgtcatcagattcatcccagcatgttcgttcagctttagcctcagtgattatgggaatggctcctgtactgggaaaggtgatatcagtgatgcaaacatgtgtttccagaatatggtgttgacaactgttgacattccatgtaagctgatcatctcttctttggcaggatgctaccattgaacagcttgttccaattttcctctctttgttgaaagacgaatttcctgatgttcgacttaacataatcagcaaacttgatcaagttaatcaggtcagtaccattttttttgttattagatttatttgccttttcctttctgttttagatttttaatgtaatcttttataagctagctagccattagtatgctagatttttttaagttgatgtccttgaaagccttgcctttctcttcaaaattatctgatgattgctgatttttgttttgatctttcaggttattggaattgacttgctatctcaatcactgctaccagcaattgtagaacttgcagaggataggcactggagagtccggcttgcaataattgagtacatcccattgttggcgagtcaattaggtgttgggtttttcgatgacaagctgggggcgctctgcatgcaatggttggaagacaaggtttgtatcattagggttatgtcaaaacagtatctctttggagctgtctccagcgtctttatcttatatccttgagtgcatattggactttgtaatgtattgactaaaattgtcagtttaactaactaaaatttggatttcaggtcttttcaatcagagatgctgccgctaacaacttgaagcgccttgcagaagagtttggtccagagtgggcaatgcagcatataatccctcaggttatttatatactatctcaataccttatatttcctacaactgtgctgtgcataatataatccttgatgctaatttatttatcaacagtagctacaacatttgtaaatgttagctatctctaaaagaggagtaaaattcattattatctccaaaacaattgtccaaccccccaaagataaattgtcattgttgtgatggcatggggtttctgctagtctttacaacccactcgcttgttttcccaggtgctggagaagatcaacaacccacactatttataccgcatgacgattctgcaggcaatctccttgctagctcctgtcatgggtgcagaaatcacctgtcaaaagctgcttccagtcgtcattaattcttcgaaggacaggtgtgtgactagaagaatgttaaagaaaaatctaatcttgtcagtttctgaacaacatggtctaaaatttttcagggttcccaacatcaagttcaatgttgcgaaagtactacagtcacttgtaccgatcctcgaccaatctgtgagttcctcaagctattccgcccacatgttaccaacattttcgaagaaggcggtacatctgtatttttcatggtattggggaatatcatcagtgcttactccgcaggtggtggagaagaccgtgaaaccgtgcctcgttgagctcagcgaggaccctgacgtcgacgtaaggtactatgcaaaccaggcactgcaggcgtgcgaccagatgatggtgtcaagctaactagcctttgtgtcaagtatttagagagttcgatcgatgctccatagtccaattttggattacctgtaatttggcctttagatttgaagagttgtttgtgtctagcctcggtaacagataaaaacggacggtcctgatccccttgttcgtttgtgttaattaatgttgtaattgagcaggacacaacgcgttgctgtgtgtgtttgcgtttacatggcagattgaactttacggtttgcttgcgctgtgcgatgctgctggcctatctacccttcgtcaatcatcacgtgtactagcgcgtagtgtggccgtagcccaccaagtaaggccttattcgtttagcatattccttgccgggatcaaggccaaaaccctatggatctcccctggaaaacataccggcccatgagaaaatagatgttcggttaaatcctgtgtgggctgcatctcggtcttttctcgtcgctccagcttgggaatcagacctgatctgcgaggccccgccccgacggcaagagccgcaacagagtcagcacaaggcgcgtgcgtgaagggcaagccacaagcgtcgatggcggcgtcagtggcacgaacacaggattcctctctccgtcatcgatctccttcggcggtggccttctcaccggtattcttctttctctctccctgtctcaactagggcgtttagggttcttgcgtctcttctgatccaccggtattcttctctctccctgtctcaactagggcgtttagggttcttgcgtctcttctgatccaactgcttaggcggcgacgagttcttagatccaacccagctagttcttagatccaatttcgagggaccatcccggcggcgctggccaaatgctcagcgctgctccacctgagccttcaagggaactcgcttaattcgcttcgctccgccgtcggccgaagcgcaacgtccctccaaagcggtgagccgcccctgaaccggctaactgcccctgaaccgagcatgtgtttccctgctgtcagctcagctgcgaggagtagtaaccggccaagggtacacgaatagttgcatcgagaataaacattagtctcttgattgatgttaccacgacacgaatcataggagaataaacattagtcttcgctcagctgactcactatacgattgcagactgactaattggccaatcaatcagagcaatcggttttggccggcatggcctgcaggcttggcggaagcgct

SEQ ID NO: 540 - protein, 583 aa, Zea mays
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKETDIVDWFIPVVKRLAAGEWFTARVSSCGLFHIAYPSASDQLKTELRTIYGQLCQDDMPMVRRAAASNLGKFAATVEQNHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILNPQLSVQHILPCVKELSSDSSQHVRSALASVIMGMAPVLGKDATIEQLVPIFLSLLKDEFPDVRLNIISKLDQVNQVIGIDLLSQSLLPAIVELAEDRHWRVRLAIIEYIPLLASQLGVGFFDDKLGALCMQWLEDKVFSIRDAAANNLKRLAEEFGPEWAMQHIIPQVLEKINNPHYLYRMTILQAISLLAPVMGAEITCQKLLPVVINSSKDRVPNIKFNVAKVLQSLVPILDQSTVKPCLVELSEDPDVDVRYYANQALQACDQMMVSS

SEQ ID NO: 541 - DNA, 3116 bp, Zea mays
aaaagcctgattaggatatacaactacaggcgccagtacgtactaatcgtccttttgagcattctgtgaagcagaacagaggcggcagagtttcagaagttctgctgccctgttccagtccttcataggtgcaaccgtgcaactgctatactacacgtaggaacagtacatcttcagctatactaaattcagttttttcttcttcttacaaacgcatattttaagctacagcattggcaggccattgctcgatttgtttttttctcggtggttggacttacatgcctacaggaaaactaaaacaatacgtatatgtggttttctgataatcaaatcaaagggggaggggggatgtgacaccagaactagttctttcccatcacccattattgtttgcttttgcccagtctcgcgaagaaaaaaaaatgaaatcaaaagaaaatatcaaagcgacgagcagcgacaactccacgtctggagccaggtgatgtatgagtgcaggtactacacggtacatagattttatttttttaaaaaaaaatcataagcatttattttatttatccccaaattatgaactggactttgctcgctggtctcgcagcagccgagcccaactgcacacaaaagaaatgggcgcatgagcaggcacagaaaaactaaacagagaaagcatgcattaattagaccaaacccaaaacccctaagcaaaagattagcaatgattggcgtctccattgtgcacttgcacaggtactagtactcctgctaggcttgttgttgtagggtgcctgccccatgcagtgcaaggagggaggggtgtgtcaccataaaaatttagcggcaagggcgagggcgattggaagctcaaaataatgagctggttgcccaccggggagacacgccggatttgtttaatcccctggccctaatcccccagccctgccgtctcctccttataagcaatggcggaggggtcttgctcttgcattgcacctccggccaccgcgccatagcccgcagtaattaagcaggcgagaacgacgaagaggcggtcacgcaccacaccgatcaatccagctcgagcgaccgatcacacgtgcagcacagcacagcacagcggtgctcggcgaagagagatgacggggttcgggtcaccgtgcggggcgtgcaagttcctgcgccgcaagtgcgtgcgcggctgcgtcttcgcgccctacttctgccacgagcagggcgcggcgcacttcgccgccatccacaaggtgttcggcgccagcaacgtgtccaagctgctcgcgcacctgccgctcgccgaccgcgccgaggccgccgtcaccatctcctacgaggcgcaggcgaggctgcgggaccccatctatggctgcgtcgcccacatcttcgcgctacagcagcaggtgtgcatgcgcgactgccccgccgcgccgtctctgggcttgtctcttaattgtgatagggtttaattgctgaccggcccgtgccaatcgatccaggttatgaccctgcaggcgcagctggcgtcgctcaaggcgcaggcggcgcaggggcagcagggcgtgcacgaagacgccaagggctacgtgggcagcgccgccgcggagcagctagggtacggctacccctggtgcagcggcaatggaggcgccgcagcagcagcagcaggcgccgtgggcgcgcccgccgcgcagccgggcgcgtacggcaatggcgcgcacgagtccctgaccgcgctgctggggtcgtcggactacatgcagcagtcgctgtaccacgcgttcgagcaggccggcgcggacgacgacgacggccggcaggggtacgccttcgaggcagcggcggagtcctcgtcgctcggggcggaggagagcgggtggaggtcgtcgtcggggtaccaagactgcgaggacctgcagagcgtggcttacgcttacctgaaccatcgctcgtaagaactgagaactactactactacaagagagagagagagagatatagatatagacatatctgtcctcaattcctgatcatgttttggactttagcctggggaaatatatgcgcgattttcgatcgatcagtcgatcggtctccgctacaaataatccagaagcatgcatgcatgtgacagaccactgatatataatagatccacacattattgatcatcagtgtagaaattaacgtacgtagcctaattaattggacaaagaaaatggagagcccttgctgtgattatgctgctagttctgtcagtggtggggttgtgttttcttctccaactctctgcctacctgctgcagcagtgtctgcagacgataaggttagattcgtcatgccggccggaaaatgtactccaaggaacatacaaggcagcatattgagagacaggtgattgattcatggccacacgtggaagatccaattagcctactattttcgttgactccttttactggaactctttctgatgggacatgcacacacatcttcagcatatatatagctactatctagtagatgatatgatagagccttttgtcttgcgtagacaatcctactatagtgattaataactctcctatatctggattattaccctatagctacttgattaccacacatgtagatattctaagtcatgaccattacatccttaaaaaaggataattatggtgactcatcataattagtgtggtgtctaataatctgtctattttttcccaggattacatttggtaaaaaccttttttctgaagttttgtttatttgtacacaaattttggttagatgtttccattgcgtagaccaccatcttttaaaccatagatgactgtttcacaaaaaaaagttgactccttttactggaactctttctgatgggacatgcacacatcttcagcatatatgtagctactagtagatgatatgatagagccttttgtcttgtgtagacaatcctaccatagtgattaataactctcctatatctggattattattgccctatagctacttgattaacacacatgtagatattctaaatcatgaccattacatacttaaaaagggataattatggcgactcatcataatta

SEQ ID NO: 542 - protein, 244 aa, Zea mays
MTGFGSPCGACKFLRRKCVRGCVFAPYFCHEQGAAHFAAIHKVFGASNVSKLLAHLPLADRAEAAVTISYEAQARLRDPIYGCVAHIFALQQQVMTLQAQLASLKAQAAQGQQGVHEDAKGYVGSAAAEQLGYGYPWCSGNGGAAAAAAGAVGAPAAQPGAYGNGAHESLTALLGSSDYMQQSLYHAFEQAGADDDDGRQGYAFEAAAESSSLGAEESGWRSSSGYQDCEDLQSVAYAYLNHRS

SEQ ID NO: 543 - DNA, 5022 bp, Zea mays
agcaccacctctaccagcttccaatcaccactagcgattaaccacaggaacactagggaccaaatggatcgaggagattggaacaacaagcagccgactggaacaaccagcagccgataaaagcagagatgagcagagaacctctccaaagccagggatgcgttttcccttcttaagaagacgcccgcacaggtagttacgcagaacccggcggcaaacaaatcgctgatctgttatcagccgccgccagcctgcgctactccttccctactaccgtcctctgccttgcgctcctctctgagccctagccaccttgccagcgcttgcctgccggctgggctgctcggccgtgggcctgatagcggcccagctcgggtggcctccctttttttaataaagtgaaaaacacaaaacggacagcaacttttacttcactttgatttcgcaacggctagccttttctgtttaccttctcctagttgtttttttttctccagccatatcgtagatctgttggtcaatggtcaaggacgccatgccagctttccgtagctggaaaaaggtgggctagtaaaagatttcgtattatacgatgtgattagcttgcgaacggccagtttgtccccgtggagctgatattgcttgctcggggtgcgcgggagtttgacagcgttgtttagacatgacgtgcacttcccaaaactagcataatcgccagtggtcgatgaacgatgaccatggccgatcagctgagagctgactcggcgtcgtccacctggaagcggacgcagcaccgaccccgcagagcagactcccaacccacacatcgagaccacagaccagtggcagcgacccaagccaagcacaaaagtaccgcgcgacaagacggcaagcggacaagttccccggaaatttttttaaaaaagcgtgagaaattcgttaaaaatcctcccggtcggccacttttattaccaccagcagcagcggcaagtcgtcgctcccccctcatcacctccactccaaacaaacaagggacggtgagcgaggaaccccaccccacgtcgccctccccccacctttctctctagtctctagtttctagtctctacccccaggccccagactcctgcctcttctctctctcgcccacccgccccggccccaatgtcgccgcccctcgagccccacgactacatcggcctctccgccgccgccgccgcggcgccgccgacaccgacctcctcctcgtcgtcctcgtcctcgccggcgccccgcctcaccctccgcctcggcctgccgggctccgagtcccccgaccgcgaccgcgaccgggaccgctgcgaggacgtcgccgccgcgctctccctcggcccgctgcctgctacccccaaggcgcccgctgccgtctccgccaagcgcgccttcccggaccccgcccagcgccccggcgctgccaaggctagcgacgacaagcaggcgtcccccgccgccccgccggccgccaagtaagaccccgccgctccgattcgccgcaggcgttacccgcagccggacgccgccgggctgaccgacgcgttgctgtcgatccgtgcagggcgcaggtggtgggatggccgcccgtgcggaactaccggaagaacaccctcgccgcgagcgcctccaggagcaaggcgccggcggcggaggacgccgcgtctgcggcccggcccatgtacgtgaaggtgagcatggatggcgcgccctacctcaggaaggtggacatcaagatgtactccagctacgaggacctctccgtggcgctccagaagatgttcagctgcttcatcgctggtgagtggtgttcggttctacgcttctgtgtgatgcgttcccctcttcctcttgtaattacacaagtgctgcggcgttcactgccatttcttgaagcgtatggattggatccgttgctataagtcctttgcgatgtactggatttactcctaaagcgtaggatgagcttgagtccaataaaagttgctttcttgaatcaaagattcgtaagactcgcaggaagatagcattcatacagcgatgcgttgtgcttgtgcatatatgatcctaaacctaatacaagcactaagcgcaatacagacatacagtcattttgtgcacgtggagaaatttctgctttatcatgccacaataagtgcaatggtccttggctccaccgctcaattttaatcaaagttccatggagctttactaacggatgaataattgggagtttgggacacgctcttgccctaacaaataacgattaatgtgagagcagaaagtaaataccttacaaatcactgaacacattttttttcatagtatgacatttttctcacaagaatatgtatttaccctgtgattttaaaggtcaaagtggcctgcataaatcatcgagcaaagacaggctgactaatggctcgaaggtggatgccctcaaagaccaggagtatgtacttacatatgaggataaggatgcagactggatgcttgtcggtgatcttccctgggagtaagtaccttacaatgtcatatattacttttaatgttgtgagcgtagaatatagttggatgttgtttggttcatctgttgtttttttatcagcagttattaagaagatattacatgattatgaaaagaatatcatatgcattattttcccctttgcgaatgcattacctcattaccttagctcactatctcaatagtgttggatttttgtcaaccagctatggtgacatgcaaataacagaaggatgaaaagaaaaaaaatgtacttgtggcgcaggtattaaacatatttgttatattgttatataattcggtaaactgattaccccgtaagaaaaaaaatgtaaaatgtacttgtggtgcaggtactaaacgcatttgttatataattcggtaaactgattaccccgtataagtttcatatacaattcggtaaactgattaccccgtatcagttttatatctgtacaagttaccactcaagatgcaagtgctgatcttatttgttccttttcagttattttacctctatctgccggaagctcaaaatcatgaggggctctgatgctgttggaataggtatgtaccatgtgtaacaatagatctagaaattctgcatctattctgtgcatatgttacagcctcacaggatatgaatttattaattcccaagcactaatatttgctgttaacttatactatacagagggtatgtttctcattgtttgcataaggttgtcttgcctgcgctttgtaaataagttaggcaaagtattgaagcattagctgcaactctatcctggctgtgaacggattgtagcttacatgcatagaccatttctcgtgactgataacagaacacaaacctaagggaatgataagatgactaaaatattggttggaagaaacagttgctgttttgctgctcgaatctgaaacttgattttggaaggtgcctttccttgttgtgtgcaactaagacccacagactatcgcattggatcctttattttgaaatttggtgcactgtttaatttagctataatatttattgtatgattctgaaccatgtccatctgcgtgcagctccaagaaccatagagcagacaggtcagaacaaataagcttggtctttgcctgcacccacgcaagaaatctgagctagctggaaggccatgttgaaggcttaaatagttgctcggaattatcaaaagtcgtcaaatgttagtgtagtttccacgtgttcttgagacgtgtgtatttgtatgtctgtgatgtgatccgtcagatctgttcttgtgcccttcaaaggccaaatcagggagctctctgcttcctgtgtatgcttgctttttccagtattccctgttattctactatgaaatcatccatcgtgccacaaagaactgatggttcctgatgtcaagaaagctgtccgaattgtcttctttttacaggagaaattggtgctgcactcagcttcctgccagattaaccttagtactaacagtgcattttacacagaactgggggtctctgggatctctgggctcctgttctgcttcctccggactccggagcatcaaaacgggcactgctgtcactgaagaaattgtagaatcggctgttcctgggaactctgggctcgtactgttctgctttctccccagcatcgggagggtccttgctgtcagtgaagatttcccctgtcgtcgtggccgcgtcaacgctctcgccgtcggccttctggatggaaacggttttgaaaatttccggtattctaaaaaccgattttttgtttttttttttcagaaacaaaattgattttcagaaatttctatcgaaatcggtatctataccccaatccaacttaatacatgtggattaaggtgaataagacattagacatgaatagatatcgaagcaatataagtctcaactgtggttatgggccatggcgtttcagaatagatgctgaatttgttgagacagtgaaaacgaaagcatgctagagtggttgcaaatttattaataaaaatgtttcttaaaattccaggtgtgaattataagcggtgtaagcacacatttgaatcggtaatatttcatatgacaagagaagctcaccgtcatctcgaaagttaccgtaaagaagagggctgatggtgacagacttcaaaaagactagttaagaagggaaaaaaactgatttgttgaagttcactcgagcgacgaggaagagaaaacttcgcttccagggcgatcagataagggtgtcgcttcagggatgcccgagagccttgcaacggctcgtgagtttattagatctttggaagagggcgaagtggtgacataccttcgcaagatcttggtgtctcgcagaagggcgaggatatggcttcgcagtaaagtgaaatgtttgttgagagttgagactgatgctggtgtgggatgtgcaagcaatccacttgttgaagctg

SEQ ID NO: 544 - protein, 249 aa, Zea mays
MSPPLEPHDYIGLSAAAAAAPPTPTSSSSSSSSPAPRLTLRLGLPGSESPDRDRDRDRCEDVAAALSLGPLPATPKAPAAVSAKRAFPDPAQRPGAAKASDDKQASPAAPPAAKAQVVGWPPVRNYRKNTLAASASRSKAPAAEDAASAARPMYVKVSMDGAPYLRKVDIKMYSSYEDLSVALQKMFSCFIAGQSGLHKSSSKDRLTNGSKVDALKDQEYVLTYEDKDADWMLVGDLPWDYGDMQITEG

SEQ ID NO: 545 - DNA, 3028 bp, Zea mays
cccctgccggcctgccggccgcgcccttgtcacgcagacacggggcgcgggcgcggattatgccgcgagcccgcgacatcgacgtgccgacgtgccttgccgcggcgaccctggcatctgcggcggctgtagtctttccgtgcgcgcacgcaacgccaacgcatggcataacacatgcacgcgttgcacccctctcacagcatgaggaccaggaccataagctgctgcgtgcgctgccattatgagccgcaatcctcgcatgcatgccattgtgccacagcatggttccttgatacagacaaaagggtaaagatttgccccggacgccggaccctgtgtgtgtccctacaatcaggtatctagagtggtcctcagagttgcagttcttcaatctctctttctcttcttttttttttcttcttctgtgtgtgtagggggtgtcagttcttctttctgtagctgtgttcagcgtaatggacgtagctgctttaagttaagcgtgtgcgttacgggtgtgctttgttgagtactgcatcattagctaggtgatgatagtcattctggatccttcattagtcaccatggatccttcttgatcatgtaaacctaaaaagttgtatgtaacaatataatcatacctgtgagtgcttccaagatatgtttatgttgataatatgatgttcgtttttagttgtattaacatattaggctttcaaaagaaaaaggttttgcaagtgtactttgaccaccacttccatttacaaaaatatatcgttaattgctacaaaatcaatatcatgttaaaatacttttggagtattcttctattcgtataagctttacaaaactaactgtccacattagctgactggctattggtcaaagtttatcgaatttggctttcattgaaacccctaaatataatactagtatgcgcgcgtatacctactaaaactgatcaggggcagtacttgatagctacttatatgctagttcgcgtcagagcttacgtgcgtcacactcgttcattccctctgacccatgacatgactctttgagtggtggtgggtaactaggttctcacaatgcaatgttgtctgcagctcaaggacatggtgctcaagttctccggctccagcaagcagtgcagagggacgcccggggcccagtcgttcaggagcagcggcgggggcaggtacctccgcccctaccccagcttcatcgacgtcaccggcttcgcgccggcgaacaaggttctcggcaacgcattggcaggtgcaggcgccgccggtggtgcggcgcgaaccgcgtcgtcggatacgttggacctgaccaggagcaaccgcaaaaccccccagagtagcggatggattccgagcaccgaggcggcggcggccggggacgatgtcagggagtggacggcgcaggtggagcctggcgtccagatcaccttcggcaccatcccgagcggcggcaacgacctcaagcgtatccgcttcaggtgtgtcgtcgttacgcggccactactgcttcccctgctcaacgactcactgcgacgaccattgattcttgcaactgaactgactcctaagtgcatggtcgtatctcgtatatgctacgtacgtcgtcgtagtcgggagatgttcaacaagtgggaggcgcagcggtggtggggcgagaactacgaccgcatcgtggagctgtacaacgtggtgacgttcagcggccggcagcaagggtgctccactccggcgtcctccgtcgacgactccgcgctggtgggtatcgctacaggacactgcatgcattgcatcgtccatcgtttcgacgacccgctttaaaaattaacccgacaaagtgttggaatgcacgcacgcacgacgcagagggactcgtcctactcccgtgtcggctcggcgagcaggggcagcccgatcacagtgccgccgccaccggtggcaagcaaagaacggctcgcccggagcgcgtcgttcagggcaacggcggcagggtcctcctcggcaccgtacgcggccgcgcattccgccagggcggcatacttcccgtccgcggccgtgcccgacccgtcggaccacgtgtgggcgcaccacttcaacatgctcaactctgcggcggccggcacgtccgcgatgggcggcgggggcccgtcgccgtacgacccgtcgtcggttgccaccgcgtcgtcccgggacgaggcttccgtgtccctcagcaacgcgagcgacctggaggccacggagtgggtcgaggaggacgagccaggcgtgtgcctcaccatccgcgagctcggcgacggcacccgcgagctccgccgcatccggttcaggtatggcactgatcagtccttcttgatcacacggttcatgccatgcatgcctgatgcctgttccatgtttctgtggtgttgcagccgggagaggttcggcgaggagagggcgaaggtgtggtgggagcagaacagagagagaatacaagcggagtatctgtagcaagcgatcagacaagcgctgatgcaattttcaggcctgacgggataatcaaatttatttgggagggggatagattagggagatgatgataccgcgctatatacatggcgaaaagaatgtgaagggtgaaactgttgaaagtgtaagaaatgggatggtacctgtctttagtcacctaataataaactaacaataaggttgtacattgttggtgccgtgtctggtttaaagttgctttgcgatgcacatctcggttccttcgttggtttaatttgttttaaaactatgtccatttcttgcaggtttacgtgagtagtatagaacagatgttgtgcatgaaaaatatcataatgctggcaaactggggtggagtttgtagtgcaggaatggtcaggtctagactctagacaacaatcgggataagttgagatggagcaaaggaatgcgtatagtttttttgtacatatatttagatatataaatatataagtaaaaaccataaagcaaattagctaaac

SEQ ID NO: 546 - protein, 90 aa, Zea mays
MLSAAQGHGAQVLRLQQAVQRDARGPVVQEQRRGQVPPPLPQLHRRHRLRAGEQGSRQRIGRCRRRRWCGANRVVGYVGPDQEQPQNPPE

SEQ ID NO: 547 - DNA, 15315 bp, Zea mays
taccgacacaacctccacaagttcaaacaaacaaacataattaagtagttagtattgtacaacttagggagatgcagaaacgaatttaacttaaaagttccctgccaacctttactctaattgtgacgaaggaagattttggatagtaaagatgcataccctttcaaaaagaaagtcatttttttatccggagcataacctaaatagcagacaaagaaaagggaaagaatgactaatgaagtggaagcaaaaagatcattgggaagatgctagcaatttctgacgagcattcacatggcaaagttttaaaatgaacatattaaggaaataacgcatagaattcaatttgcatatataaaataacatcttgaagtaattcaaattgcacaaaatatacatatgaaacctcaattagaaaaatgagattgaactttgagcctaacctcatgtttaagatcaacacatcttttcgcatacactcgactcgagtcgcaaacgtgaaatcaagctgacatgatgtaaaaagaaaggagagaatgacttaatagccatagagggctggtctgggtgccccccgccctgctcgcgagtcgcgaccgtctcgatgggcgttactaggcacaatgacggtgcaggcatcacggttgggcgagcgagacgggactaaagctttagcccgtagatcgtattaatggctgtgtaaaatattatttgatagtctagtgtttataaagtgaagtttaaaataatagccggggacgagccactagagattggagtcagccttaacaaaaacttatatttttttctgtttatttctatcggtaaagactgaagaagttctcccagacatactcaacttaggaccagtagccacaacgcctcgcaccagcgaccgccgacccatcgccacgggccggttccggttccaccgcaagtctcccactccagtgtcgtcggtaaaaccgtaacgtccacacgacggcgagtagtactactagtgtacgcggaaaatgatttgactgttctctattccctcgccctctcttctcccagacggccagacgacgccaccgtcacgccccaccaccaccaacctatcccccaccgcgtcacgcgcctccacctccccagatcggcggcgaaccggggggcccggacaggcggcggagagctcgaggcgtcatggcgaagtcgagcgcggacgacgccgagctgcggcgcgcgtgcgccgcggccgtggcggcgtcaggcgcgcgcggggaggaggtggccttctccatccgcgtcgccaagggccgcggcatcttcgagaagctcggcaggctcgccaagccccgtgtcctcgctctcaccggtcagcgccccccttctccctcctcgccccactcacgtctccgcttcgatttgctgcgctagtgctacgctgcgctgcgagcgaggggtgggctgctgagcaccaagttgggttgcttggagcggatttggcgcctaagaggattgtgccgggttcattggtgatgtcccgcttcattgccacttgcacgactcttgctcggacggtcgtgatctgggccgcttggatccccacgaagccaagtcttgctcgctatgctcttattcacacttgccgctggcttgagaagatccgtgttgcttatctcatgctgctacctggaaaagtagcccgcattcactacacctggatccacttttcatagtttaagcacacaacttggctatttacctcacaaagctctagcaagataatgcgaacccaaacttacacattgctggactataacaactaaggagcagaaaagatgagcaatcgtcaactgccaaatttgatgtgctggacctctttataggtccttctgaagttagcagctggagctaccacagttagccagaggggatgatttacagttccactttacacactggaatggcgttgttatgagagagctcagaatatgaggctatgagcccataactggtggattcgaggattgcaacaacagtgatttctttgttcagatatttgttgcattcacatattcatatgagtagatccctagcttagccataatttgttttggatgaaagaagcagtgatctatatgcagttgtcattcacttgattgtttgaagataaatggagcctaaccatgtagtacccgagtctaattggaggagttggctcttgaagatgatccttgattatgcattcatgcttcagtcattatgtctgcccaatacgtgatttgctttattttggatttattaccgtggccagtgtcagtttgctgttttttctgttcagtaattcagtaaatatcttgggtggcatatgataggcatctattagtaaatatctcactatgttattggaagcatagggtaggaactgtgttatatagaagatatatgcttgcaacatctgctgaacaattttagcttcacgcagttaaacaatcatcaagaggcgaggcgaacaaagcttttcttcgagtattaaaatattcatctggggcagtgctcgaggtttgttttcaatactgacaactttgctatctaatagttgtccatcacaggaatggggtaatcttgtttggcgccttaagctttcatgagggtatacatgctgttgttgaaagatgaaacactgggtcactgtgcattttcattgcatacatgattacatatactattatctttcttctgtttcctatcactcatgattgattgcattgcatgaacactacctcaagctagcattgcgtattgtaatactcctgcatcaataaaatactgtactaatttttccccctctggcttttggtgatggttgttgcttactttgctgcgagaaacttagtcttctcctgttctttttcttctatttcagccagccaaactttacaagctgaaacatctaacaaaggttgaggttatttccaatgatcccagtggttgtacatttgttctggtatgtactttgatctctttcgcaatgcttctggtggagtatctgaagagaacatcggttatatccattactaactctttatgttttatgtccggactgcagggatttgataaccttaggagtcagagtgttgccccaccacaatggacgatgcgtaacattgatgacaggttgttgcccagaaagtttgctgtgtggtattagactctgctagagtgctaattttatccaacttcttgtctcttgtgctttaaatctcattctttgctatatattttgcagaaatcgtctacttttttgtattctgaatatgtgcaaggagatactcagttatcttccaaaagttgttggaattgatattgtggagctagctctttgggcaaaggtgtatatcaaaattttccattcgttgtgattgcgagcttgcctttttgcgccctctctctctcattgtttctaataaatagaatatctatgttccacatagtgatttcttggaactaatttgacacaaattgcctatctatggtatttttgcgccctttctctcattgtttctaataaatagaatatctatgttccacatagtaatataccatgatttttcatccaaaacccaacccgacccaacatgttcaactgggaggtacggtccaacccaacccaacacgttcaaccgggaggtacggtccaacccaacccgacactagacatgagtcgggcatgggccgtgtcaaacaacccatgacccgaccttgactcatcccgaactcgaccgacgtttgaacatgtctactccaaatcggtttattagactgtctccagtaggttctctaaagcctcctctaccgtaaattttatgaaagatttccatccttcatgtctccagcaatgtcctctaaatattcctctaaatatagaggatgttgctgaatcctctcgctatatagtttctctctcctctcctctattcgttttaatatataaaacaacatatttagcaaaactaaaatatgtacaagtacaatacatttgagagtattacaaatacgtacgtacaaaagttaaaagtaaaatatgtctctaatataggtatttacgtatagagaacgagatatagggaacgttattggagtaacactcccacttacgttgagtctcttttgggtctcagacgtgaaatatgagtgagctataattattttattttaattgcacttaccaggattcgacttgagacctctggctctgatattatattaagttccatgcaccaatcagtccaattaatatggtatcagagcttggactggttgatgcatgcaacttaatatgatatcagagccagagtagtcgagttcgaatcctgtttagcgaaattaaaataaaatagttattgttcgctcctatttcacgtttgagatccaaaagggactcgacatgagtgagtgttggaatataatataagtaaattgctcacctcttcctattataccttgtacaacagttcactcacatggtcaatcgaaacactgttttgcactgtagactgcattgttagcagagtggagtttgaatatgggtatgtagatgagtaagctgctggagatagccttagcttaaacctttgggttgaattgattggtgacatgcaatttaataaaaactagtctcacaatgtcatattttttttattttgtttaaataaattgtaatagatactgctgaccgaagttatgttttgaagacctggtcactggccaaacttatttttattcaaggaatacaagttaaagaaaatagagaagatacagagttacagtttgcgcttcacaaatcctacataataaaaggagggagtactatatcaattttcttgtttctgcaatgcctagctcatttttagtttacaccttaaacattaaagcctgatatctctactgatatttcattttttgggcaacatttcacatcgatttggtgctcactaatttgatctccaaattttcaccaaaatgatggtttggcttgatatgccccttgatggttgttgtctggatatttttctaatgaacctgaatcctttttaggaaaacacactgaccatagataatcaagtgagtacccaagatggtcaagaaacatcagttgctactcaaaccgagaggaaagtaacagtaactgttgaaaatgatctcgtgtcccaagcaaaagaggaggaagaagacatggaggcacttcttgacacgtaaatatcttatcttacatagatttgcccctgattattgcaaaaaatacaaccaaaactgcatacaacaactattgctgtcttttagggcttgttcgtttgtgccggattggtgggtcggaacgattcctaaccggattgcttctttaatttatataaactttgattaggtggaacgattccgggtgcaatccgacacaaacgaacaaggtcttagtttttttagctgtacacctatattattctagtagttcattttgtagtttttgaactttttatctgccattttttataatacaaggagttcatccctaattctgttgagattaaacctagccgtgatcttttttcccatgttaacacaagttgaaacatcaggggatgcagttgctcatgtgccctattgactcgacctcatggtgtgacaaccgatagaaggaccatactaaactcatacaaaatcttactgcccaaagatccctttgcctttccaatgtaccacgtgtaattagtttgcatatcacttgcatctgaccttactattgctgaaatgctttcagtactttggtaccactacaatcttactagcgtaaagccgtaaataatgcaggtatgttatgggaataggtgaagcagatgcattctctgagagattgaagcaggagcttgtggctttggaggctgcaaatgtatatcaattactggaaagcgagcctttaatagaagaggtattgcttctatgttcctttgcaatgcaatattgacttttgtgcactaattatgatatagtacagcatctgactgccattactcatctcacttttattctggagtgaatgttttgttttttggtatggaagcttattcattgactgatctagttgcttggattttcaggtcttgcagggtctggatgctgctagtgcaactgtagatgatatggatgagtggctacggattttcaatctgaagctgaggcacatgagagaagatattgcatcggtatgtttgaggagttttttagctgtctgatttgaagcggatatatatttcttctctagtttatttgttttactgttagaagcatagctatgaaaagttgaaaacagagactaccagtttgacatgaaaagccaggattagtgattggccctatctggtatatggagtttactgataagtggaaatcagtgggatatagatgttaattgaaaatattcctctgcgcctctgtagatcaaaccccattatttgccattcaaaacccaaaggatcttagcacccgtatgctgaatacacatgcatccagaattatagcccttctgacctgattgtctgactcttctgacgacatatctgtctggcttttggggtttcagaaaaacttaagaaaaagacaacctatcaagctgagtaatactgacaacctgtactagtttggtagttgtaactagcacctgagctacaaggtctgttgaatcaactcaatactcacttggaatctgaaggtcctgaattcttgcttgcttgttatcatcggtttcagaattttggtagaatccttcctttggcatcagcctggcctcttggacttgtcattttgaaaaattaaatattgtgcctgtttttgtggtccactggtcctgctgcagtcatttgttagcagaagacacaattttctagatgctgataagaaagaacttcactaattggtcccctactatctaattttgcagattgaatcacgtaacaatggcttggagatgcagtctgtaaataacaaagggcttatggaagagctagataaattgcttgagcgtctgcggattccacaggaggtatgatggagaggaataatattcatctccctaaattgatgtctaatatttatttatttatttatttatttttgcttatatccaattcagtttgcagcatcattaactggaggctcatttgaagagtcacggatgctgaaaaatgttgaggcatgtgaatggttgacaggggccattcgcagtcttgaagttcctaatttggacccatgctatgtcaacatgcgcgctgtgagctacctttttcttgttttctgctacaatttacaatttaatagtgcatggaattgatcatgctaacattgcagaattgttaatattatagagttgtgacactgtgaacgttgaataacattacaaaattgttaagacttgttttgtaagagtgtgttcgtgttagcgaggtgggtatgttgtaatttttttggtttctccttaatgcaatgatacacagctctcatgcatatttaacaaaaaatcttttgtaaagtccacctgtattggttaaggaacaaattttaagaatcactatgcttcatatgctttgggtgtcaccatttcctcaataagccctatttaagtttttctttgtagtagcttaaagttgagaactgtgcatctctgataaattacttctgtgtaacatcttgtcaggttagagagaaaaaggcagagctggagaaactgaaaacaacttttgttcgacgagcatcagagtttttgcggaactacttctccagtttggtagacttcatgatcagtgacaaaagctacttttcacaggtttcttcatagcttcatttttgaaagtaaatatttcctttcccatttgagatgaccgacagagttcacttttaactgaaagcagcgtggacaattgaagcggcctgatcatgcagaccttaggtataaatgcaggacatatgcccgacttctgcagcacttaaaggtaataattgacttaattttgccaaggggtctgcctagatattacatatttacttcattgacacatttgacatgtatcatttcttgttgctaattactgcagagtctggacaagagctgcttaggtcccttaaggaaggcatactgtcattcccttaatttactactacgacgagaggttagatatggataatggaatgctttttttaatttgattccatacagttcactttttgtttatctaatttcaaatatgttcattttgttttaatctcacatttaacaatttatctttttgtttgtttgttttgagtcctctgcttaatggacagttactttacaatccatttgccttctttatttgattttaaaggattcacaattttgaagtttactgtttgatttggttcaggcacgcgaatttgccaatgaacttcgtgcaagtacaaaagcaccgaagaatcctgctgtttggcttgaaggttctggcggctctggtcataatggaagcagttctgatacttcacaggtctcagatgcatactcaaagatgcttacaatatttatcccgcttcttgtggacgaggttgctcctttcctttcattaaatgtagctacatgactacctttgtttttatttgatagacaaactaatagctattacctttgcagagttccttttttgcacattttatgtgctttgaagtacctgcacttgttccagctggttctcctaatgctaataagagcaaatccggaggaaatgacccggatgatgatctgggtcttatggatccagatggcaacgatctgaaacctggtaccttttcttgtactcactaatatgtgttcgtggatgtaatgttaatgctctatttcttattttttttatgtgttgctatcctgtttacagacagtacctctgctgaactgggtacattgaatgaagctcttcaagaattactcgatggaatccaggtatatttcgtgatatagaacactgcaaccctgactcgtccatactgacggaaagaagagtaaaaaataattttttttgataggacaaacatgaagtacttctgatttaagtcaattgtgcattcttctgttttttcatgtgcacattattgtgcagtattgcagttgccaacttccttcagtgactgaaatgttttcccccttgtattccaggaagacttctatgcggtcgtagattgggcttataaaattgaccccttgcgttgcatctcaatgcatgggattacagagcgttacctttctggacagaaagctgatgctgcaggatttgttcgcaaactacttgatgacttggaatcaagaatatcagtacagttcagccgggttagttcccttgttgagcctaagctgctcggtgtgactattcattacgggctgattttctgtccactgcttgttcagatctttatttcttctctcttttcagtttattgatgaagcatgccatcaaattgagcgtaacgaaagaaatgtgcggcaaactggaattctagcctacattccaaggtatttgcactggatggattagcactgtgatttatttgtaattccagtctttagtgctactccctctgtcccaatatactagtcgttttaggcctatattttttatccatattcaaattgatgacaatgaacctagacacttatataaaactcatatatcaaatattttatgaatctattaagaccctaaaacgaatactattttgggacggaggaagtacaatttaagactaccccctgttctttttataaggcttattgggattcggagatttttttctagtgtactttctactttgacagtcaatttctcatacaatacctcattaattactataaaaccagcgtcacattttgttgatataaatgtcataaattaagcacacatatcatttgactagttgctagttggaatttatgatgtttgacattttcaaatcctaatataccttgtataaacaaatggagggagtactcttatgttatgagcggcagatggctgcgagggttagagggcgatggctagggtttgagggcgacaactagggttatcggcgctgtggaggtcggccgcagggctttgcccacggctggcaagagagaagggatttccttctaatctcttgcttaccttcaattgatacaatccctctccttatatagagagggttacttgaccctaagcactaaatctaatcttatcccaaactagtctatctttatctaaacaacctgaggggcgtgctacagagccgctgttactgcagcggcactgtagcaggccctcttgggccctgacacttatgtatattctgacacagaaatggtgattaaacattccattgcatgttagctcaccttttgtgtattgtcatattaaatcctaattcgtgcatcctgcattactccctccgttctagtatataagacataaccgctttttattctaatcccataatataaggtgtgctctctctgcatatacgtacatcgatatagtagtattagtgttgataaagagaattaaatatatttcttggtctttgaactagaagtgggtacgtcttatgtactaggacagagggagtattatttgttaacattttaatttaattgcacttagacaaagaataaaactcacataatagctcataatattcataggaacatacatgttaaaacattctcattggtactttgcagaaccttgtttacatgtggtaacacattgcctgcatcattatattccctgtgaaaacaatatagaataaatttgacatgacccagcaggttctcacatatgttttgcctatgctcagctcttacccaaaaatgtaaaaactggcaataagcagcaagactccggtgctcttatccttggcactggtgattatatgatttaagttctgcttcaagataaaaagagcactatggagaaattgtgcttattgcagggtgtactgtgacaagtttttttgttgtcttagagattcttttctgaagtggcaaacatagaccaagatctgactgtttgtttcatatagatttgctgtccttgcatcacgtatggaacaatatatccaaggacaatccagggatttaattgataaagcatacacaaagctagtgagtttcattcccttgcaatcttgcacttgtttgcattcttggtatacatattttgccgatttagttcataaatttgtgttagtacttagtagtactgtacatgggcatatgacatgtggtatactttgggttgtttcattgtttgcttgcctatcaacacttgtagactccatgactttataggtgccattgaaaggtgtctttcgttaatagattaccttctaaaaaatatacacaaatatttgcaaatttcttccattgcactaaatagtgtatagtagttttttgtatcctaagttctacttctatccaatgggactgtaatttagtgttagaatcccggttttggggtaagccccttgtaattacattcttactcctatgtaatgggccaggcccaacaaccttggtctattaatacaactcccaaacctgagttagggttagggtttcccacatggtattaggctaggtaatttttttccaccccagtcgccgactgtcatctctccctatttccacctccaaccgccgcgggtgccctccagtacctgacctttttcaagcccgacatcgcctacgctgtccagcaggtgtgcctacacatgcacaccccgtgggagcctcatctcaccgctctcaagaggatcctgcgctacctccgcggctgcctcgactacaaccttctactctgactctccccgacgtcggagctcgtggtctacaccgacgctgactgggctggctgtcccgacacgcgtcggaccacttccggttattgacgtgttcctgggcgccaacctcgtctcctgctctagcgcagaggtcgagtacaatgctgtgaccaacggtgtggcagaggtctcttggctacaccagcttctccaggagcttcacagccctcttcagcgcgccaccctcgtctactgcgacaacatcagcgcggtctacctctgcaccaatcccgtgcaacatcagcgcatgaagcacgttgagattgaccagcgtgtcgctgccggtgatgttcgggttctcagtgtccccaccacgcagcagtttgccggcaacctcactaaggagctatcgtcgagtgtattcgccgattttcgatccagtctcaacatctgtacaggatagagttgagactgggggtgttagaaccccgtttaggtttttgggcttaaccccatgtaattacattcttacccctgtgtaatgggctaggcccaataaccttggcctactaatacaactcccaaccctgagttagggtttcccacatttagattttagagatacatggcataatgttgccaatagtcagtttagagtcaaggaagatttcgtcctaagattttgcattattgtaagatttctatcttacttggtagaaaattgtattaccgattttttttgtaagttgggcactttttttatttttcaccatatggctaaaccacatttcgtatcatggaataggttagcacaatgttcgcaactttggagaaaattgcacagagtgatcctaaaactgctgatattgtgttgattgagaattatgctgctttccagaacaggttatgtttcttcatctttccttaacttgggcttgtcctatttgttgagcatatgatctttcacttatatacatccttgccttttcatccttcatgcataggtgggtctacaaaactaacaatatattatgtttgatgcagtctttatgacttggctaatgttgtgccaacgcttgcaaagttctaccatcaagccagtgaatcatatgaactagcttgcactcgccatatcagctcactcatttatctggtatgtaaacttattcaaattttcttgtgggatattgtctgtctctgacagatctaagatttcttttggacctttggcagcaatttgagaggttatttcaattcaaccggaaagttgacgaattgacttacactattgctgctgaggaggtgagctaactttattatactccctccgtcaaatggatgataatgaatgtaaacatatacaaaacacatacatcaagtattgtatgaatccaccaattctctaaaaaaaaatttattttgggacagagaaagtatgatatatatatacttcggaagtgacaataaatgagctttgaatattcatttttttattaagccgtctaatttttattgtcaaaatttttcagataccgtttcagctgggattatcaaaaactgacctaaggagggtactgaaatccagcttatctggggtaagtaaatctatatctgcttcatgaatcagttgtacttcagagctttttacagagttgggtggcagttgtcacttcttgccctaagctgtgacctgtgagcatatttccatgtggggttgcagactaactactgtcttgtattttcaaataaatcacatcaatttaatgcccaattattttgtttgatcaagaggctcgttcatcccacggtgtcaccatgagaactgacacagtgtaaaactgtgcagattgataagtcaattagcgccatgtacaggaggttgcaaaagacactgacctccgacgagttgtttccttcgctgtgggacaagtgcaaggttagccactcgaccatcctattattatgaatgtttggttcactattgcccccaggagtcattgcttgagacgttccacttaagctgattgcttaatctgctcaaacacttgcagaaggagtttttggacaaatacgagagctttgttcagatggtaacacggatatatgggaatgagccgatcatgtcagtcaacgaaatgaaagacgtccttgctggtttttagatacaagtacacagcaccatgtatgatttcagagaaatagctatgtattccattcattccattgaattctgcacccacttgcgttactgtgttaggcgccctttttgggttatgtgtgtgtatgtggatgtcctctgtatagaagtgaacgcggcatgcttcccctaatgatgttcctgtgtcgcatcgagccgtcagtgacaatgcaaactgcaaacccggagtaccggaaggaacatgttcatgtttatgacgtcatttgtccaattgccgttccattcacggtcaagaaggtcatgtcttgccaagttcgctttgtttcctggtctgaggtctcattgctactttcggttgttcagctgaagactgaagtgcaagctatcacgtgtcgggctccagttcgttagtgtggccccatatgttgcgggcttcccagcttagaaacatgagcatctcaggtgtcgaaacacaaacatagaaataaaggggtggcgtttgagagaaaaaaaaagtgtgaggcaagaagagcgtgatgcagctcaacagtgcttgaaagtaatcagagggtccgtgctcttgctgaagcacgagcctcatgattgtaagagtcattcttttactatcactgctgcatcagggtcgctctacctcctcgcaagtatttactatcaattatatattttaaaaaaccaaatgaacaaacaaaccgaaatttcaggcaacaccccctatttcagattgtgcaagcataatgaaacagatcaccaaaagaattcatagaaaaagaagggagagggattcaagatcctagaggattggtgcatctcaaatcgaatcgagaggaacaaggtcgcaacgcaaagaaaggcgcaagcagagatgagcagaccggagggaaaaacaggagacgaatgctggcggcggacgcgaatgctgactggactgccatggcttcctgaaaagctctgttgttgatttatagcacgagcctagggttaggagcatccccggaatttacgtttctgcccacccatgtggtgcgcgtggcctgagttttctgctcggtgagattttttttttagaatggagatccatctgggctacccccattcggcagtggcgacagctttatcagtgctgctgctgcacccattcgcgacatggactttggcccattcttttttcacatatactaatcatccgttctaaactataacatttttttgtctttttacgtatattagtctatgataatcttttactttttacactattaatcaat

SEQ ID NO: 548 - protein, 889 aa, Zea mays
MAKSSADDAELRRACAAAVAASGARGEEVAFSIRVAKGRGIFEKLGRLAKPRVLALTVKQSSRGEANKAFLRVLKYSSGAVLEPAKLYKLKHLTKVEVISNDPSGCTFVLGFDNLRSQSVAPPQWTMRNIDDRNRLLFCILNMCKEILSYLPKVVGIDIVELALWAKENTLTIDNQVSTQDGQETSVATQTERKVTVTVENDLVSQAKEEEEDMEALLDTYVMGIGEADAFSERLKQELVALEAANVYQLLESEPLIEEVLQGLDAASATVDDMDEWLRIFNLKLRHMREDIASIESRNNGLEMQSVNNKGLMEELDKLLERLRIPQEFAASLTGGSFEESRMLKNVEACEWLTGAIRSLEVPNLDPCYVNMRAVREKKAELEKLKTTFVRRASEFLRNYFSSLVDFMISDKSYFSQRGQLKRPDHADLRYKCRTYARLLQHLKSLDKSCLGPLRKAYCHSLNLLLRREAREFANELRASTKAPKNPAVWLEGSGGSGHNGSSSDTSQVSDAYSKMLTIFIPLLVDESSFFAHFMCFEVPALVPAGSPNANKSKSGGNDPDDDLGLMDPDGNDLKPDSTSAELGTLNEALQELLDGIQEDFYAVVDWAYKIDPLRCISMHGITERYLSGQKADAAGFVRKLLDDLESRISVQFSRFIDEACHQIERNERNVRQTGILAYIPRFAVLASRMEQYIQGQSRDLIDKAYTKLVSTMFATLEKIAQSDPKTADIVLIENYAAFQNSLYDLANVVPTLAKFYHQASESYELACTRHISSLIYLQFERLFQFNRKVDELTYTIAAEEIPFQLGLSKTDLRRVLKSSLSGIDKSISAMYRRLQKTLTSDELFPSLWDKCKKEFLDKYESFVQMVTRIYGNEPIMSVNEMKDVLAGF

SEQ ID NO: 549 - DNA, 4611 bp, Zea mays
aatggatagttaaaggtgtacctaatagttagctggactattagatggggacatgtggtgtctagatgtctgtaactaaaagtagctaatagctaaactattagctgtgtggtttggatgtaccctctctctcggactataaaagggagagggtgtcctactttggttccttctcggatctcccttttagactcctcttttatcacttagtcatttccaagcaatactaaaccatccacaaagtggatatagatgtagggtattacgctctggcgcggcccaaaacctcgctacatcgttgttctgtggtagtgtccacgttctcgctgtattctctccctagttattcggacaaggccaaactgtccattggtattaatatcacggtgatgcctaacccatgctgaacataaacagaagatatttcccctcttaccgtcaaccggtaaccctaccgaacctaaacaggggtatttcttcgtatccatgactgtcaaatgacgatgggcagagacattctggatctctggaattaattattttcaatggcaaagacagacacttaaaataacaatttctagagttattttctaagacttatttctcaccggtgaaaataagaaagtaatgttaactttttgatgtcgaactttagacggtaagatgccttagaaaatgacactaacgccgcgaaaaataagtattttttacgtccactaaccgtaaaaatgcctattttcctatagtgataaagccttagctaattgatagttacgtttctccaaatcaaactttcatttttcagaacccgttggaaatgcacgcgctgcgctaagagcaaattaggacaagcaatcgcgtcatatgccaagtgcagtgtatatatataacaaaccttagcatggacagaaaataaaaattgcaccgaaaaggggacagattccattgcacacctaagcaaggtagccccttggatctccctataaatgcgcaggcagcaatcccattagagtgtggaagcagcacgcaacactgtctcctcccctcttctacctcgacccatcacctttgcatagcatatatagcgcagcagctcactgcaggcagacgaaacaccatctcttcacatcacatcagagcagagcagagcagagcatcacccgatcccgatcccgctattcccagcctgcagtagcagcagcagtcgcgccgccctgcccatcgatccatctggctatcatacctgtcgacatggaaggcggactgagcccggagcggcacgcggcggctgagccggtgcggtcgcggtggacgcccaagccggagcagatactcatcctcgagtccatcttcaacagcggcatggtgaacccgcccaaggacgagacggtccgcatccgcaagctgctggagcgcttcggcgccgtgggcgacgccaacgtcttctactggttccagaaccgccgctcccgctcccgccggcgccagcgccagctgcaggcgcaggcggcggcggcggcggcggcctcctcgtcctcgtcgggatcgccccccacgagcggcctcgcgccgggacacgcgacggcttcgtcgacggcggggatgttcgcgcacggcgccacctacggctcgtctgcgtccgcgtcctggccgccgccgccgtcgtgcgaggggatgatgggcgacctggactacggcggcggcgacgacctgttcgccatctcgcggcagatgggctacgccagcggcggtggctccggctccgcgtcctcggcggccatcgcacaccacgagcagcagcagcagcagctttactactcgccgtgccagccaggtgagcgcgccaaaagccacgccacgctatgcatgcatgcatgcttcgtgctctcgatccatggatgcatgggtccatcgtccatgcttggttttcgtccagtttaatctgtgctcttaatcaagaacttgggtttcgaattcagggaaattagaccctttcactgctagccctcctataaagatcatacccatactggcatgcaaaggcaaaagatccatgcataatttgctatgcatgctgtgcagcagaggtcgatcgagtctcgattggtgctacctagctgttatcttcgggtagttagcgacaagcatatcatgccaatgcgaagaactagatcctgctgggtattagatcaatcacatctaccacaggaacttaactggaggaacagttgagttcttatgatggacggtgggtgttcatttttcgtttgaccgggagctatcgtccaccgccgtatctgctaattcagacaagacagctcgctgcatcactactcaattgtgttgtgcttaattatgtagcatcatcagtagtagtagtataatacaaatactatctagtaccttaacacatgccggccgcatgagtgcttgcatgcgatatgcagctggacctgcaagcaaatactaacatgttttgctcatgcatgctgtgatattaagagtaatggggacccagttccagtattctaatttctagtacacatgctgcacgcatgatcagaagataacatagcaatataattgggcagacagacatcgtccaattaagttaacaagacgtacggtgtgttgtatgatatatgcatgcagcagcgagcatgacggtgttcatcaatggcgtggcgacggaggtgccgcgggggccgatcgacctgcggtccatgttcgggcaggacgtgatgctggtgcactccaccgccggcctcctccccgtcaacgagtacggcgtgctcacgcagagcctgcagatgggcgagagctacttcctggtcagtatctctctctctctctaagatttggccacacgatttaattaactaggtacaatgatttacctgaatgatgatgaacgatagacgacgatcgacatcccatatgcaagcagcaagcatctgggcctataaacacaagcatattatatatataacatgcattaacatggtagctgcatatatatatatatatatatatatatatatatatatatatatatatatatatatatatatatatatatatatatatatatatatatatatatatatatatgtagtagtagctgacgactgatccaaccgtcttgttgttttgttcccctaatgttggacaggtcacgaggggctactaggtagctagctatagcacattgcattgccgacatggagaccccagagctagctgcagtacacgtactcctccttaccatgcatggaattggatgttatttggatcgtcggagacgcatgcatgctgcagtacctagtatctctgtgtacgtgttcttcagtgaatgtctgtcagctcttgccgtccgtccgtccggtgtagatcagaaaaaggaggcaaagaattcgataccagcagtgtgtgtgtgtttactatatagagagagacagacagacacacacaaacaaatagagtgtacctacgacgcatccacatcgaacatctatactaagtatgtatgtaatgatcaatcatatgatgagtcgcaccattgcacgcatttgctttaatgaacctgaatgcaatgcatgttgcaacttgctgctgctgcgtggtgtgctcgggtcaagtcacatcaggcattatccatccatccatcgggctggcatcggacggcgtgtcgagcgcactcggccgcaagtggcgacctcaccgcccgcgccggccaaatggaggccaccgcgtgtctccttccgagacctctatctctgccgaccgaccgaccgcccgcccgcccgccagcttcagcaatcagcaatcagctagaagcagacaacactcaacagagcgagcagcagctacccaccctcttcattcttcaccgtactgtagttgccatagacagacatcagttcaagcacaagtgatcaatctcttatacttctctgggatgaaggaaacagtccgattacgaccaattcgttctaggtgtgtgtgtgttaagagacgacatactcccccagtcaagtcagtttaccaacgacccatttggaggctggagctgtgctggatcggtggcagcagagcactagctgtaaccctaaaagctgggcgccgcatgacccagcacacacttcaattctctgcacccggtcacctgtcacatctgcaaagagagggtactgaaccacgaagctagcaagctttacgaccaagctgatggtacaaaggcaggcagcacgacgacaataataaaggcgcaggcaggggggcaggcattccagctaatcgcagcgcagaagtgtagattagagtagagtggagtagtctctccttaaaaaggctaccgaagcattcgctgttagtacagtatagaagaaaaaacagaggctctgtactcatttcacttttgagggggggctgtttgatcggtgacctctgcctgccagacagcgattctggtagctctgtctgaaacgacgtcccggaacgaggaacacggccaccttccaagctgaattcttcagtcccaatcactcgtttcagcctacggctacgggtgagaatacacagaagcccagtaacacgaacaagagacggaga

SEQ ID NO: 550 - protein, 259 aa, Zea mays
MEGGLSPERHAAAEPVRSRWTPKPEQILILESIFNSGMVNPPKDETVRIRKLLERFGAVGDANVFYWFQNRRSRSRRRQRQLQAQAAAAAAASSSSSGSPPTSGLAPGHATASSTAGMFAHGATYGSSASASWPPPPSCEGMMGDLDYGGGDDLFAISRQMGYASGGGSGSASSAAIAHHEQQQQQLYYSPCQPAASMTVFINGVATEVPRGPIDLRSMFGQDVMLVHSTAGLLPVNEYGVLTQSLQMGESYFLVTRGY

SEQ ID NO: 551 - DNA, 2828 bp, Zea mays
acgataaaactacatgcgtcagtactaaccgtccttttgggcgttttgtgaagcagaggcagcagagtttcagaaattctgctgccatgttcctcagtccttcaaaggtgcaactgctatatactatagaaagaagaaaacagtacatcttaagctataacaaattcagttctattataaacacataatttaagctacgaattggcagaccattgcttgatttgtttttctcggtggctggacttacatgcctacataaaaaaacaaaaggaatatatatatatagtttactgataatcaaaccaaaggggagatgctgacacaagaactagttctttcctatcactggataccatgtgctaaactttatggtgctaaagtttaacataccttgaggagttaaactgttattggatgttaaagtttttcacttcacttttaacattcatgtttggatcttaagtactaaaagtataatgctaaactttagcatacttaagaaactaaactggtattgggtactaaagtgctaaaaggtcataaaatgaaatgctagactttagcacagtgtatcaaataggtccttagtctcccaaaacaaaaagagagagagagagagataaggaaatagtactcctgctaggcttattgtagtagggtgccccatgcggtgcagggagggtgtcaccaaaaaaaaacttagcggtaaggagcgagggcgattggaagctcaaaataatggagctggttgtccaccgggcagacacgcctggtttgtttaatcctttggccctaatcccccagccctgctgccgtctccttctcctccttataagcattgccgccccgcccccatcctccaccgcaccacagccgcagtcagcagggcaagaacacgaagtgatcgtcgccaccgatcgatccagctcgagctgagcgagctatcacgtgcagcacagtgcagtacagaacagctgtgcttgcagtcttgcagatggagatgacggggttcgggtcaccgtgcggagcgtgcaagttcctgcggcgcaggtgcgcgcgcggctgcgtcttcgcgccctacttctgcgacgagcagggcgcggcgcacttcgccgccatccacaaggtgttcggcgccagcaacgcgtccaagctgctcgcgcacctgccgctcgccgaccgcccggaggccgccgccaccatctcctacgaggcgcaggcgaggctgcgcgaccccacctacggctgcgtcgcccacatcttcgcgctccagcagcaggtgcactacggctgcgtgcacgaagtgcctggcggctgccgccgccgccgtctccgctttgtctctcgtgacggggtttaatttgctgatgacccgtgccgccgtgcaccccgattccgatggatccaggtgatggccctgcagacgcagctggcgtcgctcacggtcacggcgcaggggcagcagcgcgtgcacgacgtcgacgacgccaagggctacgtgggcaccgccgccgcggggcagctagggtgcagcagcaatggaagcgtcgcgccggccacgtacggcaatgtcgggcacgagtccctgaccgcgctgctgaggtcggagtcggactacttgcagcagtcgccgtgccacgcgttcgagcacgccggcgcggacgacaaggacgacgacggccggcaggggaacaccttcgacttcgaggcagcggccgactcctcgtcgttcggggcggaggagagcgggtggaggtcgttgtcagggtaccgagactgcgaggacctgcagagcgtggcttatgcttacctgaaccatctctcttaaaagagctgagaactacttactcgtagtgccggaaatgtatcacaagagatcagagagagagatcatgttttggacttgagcttgggatgtgtgcgattttcgatcggtctccgctagaaacaattcagaaggtagcatgcatgtgacagcccgttgatatactctcgccgttcttttatttatttatttatttatttatttatttatttatttatcacattttagtttaaaaataaactaacaaatattcaataacagagatagcacatgttggtcaatgtagaaacgtaacctaattaatcggatagaagaagaagagttattgctatagttacgctgctagttctgtaagtttggagttgtgttgccttctccggttctctttcttctgtaagagacagctgactgattcatggccacaccaggttggtgattttggatatgcttcggacctaggaaatcatgcagagtacagtggagctcccaaggaggatgttaggaatagggttggcaatggggcgggttcgggtcgggtccctgcggttttagacccggcggtgttcggggcgggtttaaatttttacccgcgtgtccacgggttcggggcccgatttaattcggtttcgaggcagttctacattttcaaccgtggtttttttgcggggacccgaaacccctattaaaccgagtcagcccactaacacaagcaactgaactcattgaaactagccaggcccagcccaacatggatgcaaagggagaaattgcaaaggcaaaaactccttgggattttgtaccagcagtgtacagaatagggaaacctgcacctcttttttgggtccccgacgggttgcgggcctccacgggttcgggttcgggtccgtgttttcacccgtagcacatttcgggttcgggtcgggtctgtaattcgggtttcaggtgcgggtccgcgaacagtgcacccgacccgaacccgccccattgccaaccctagttagga

SEQ ID NO: 552 - protein, 232 aa, Zea mays
MTGFGSPCGACKFLRRRCARGCVFAPYFCDEQGAAHFAAIHKVFGASNASKLLAHLPLADRPEAAATISYEAQARLRDPTYGCVAHIFALQQQVMALQTQLASLTVTAQGQQRVHDVDDAKGYVGTAAAGQLGCSSNGSVAPATYGNVGHESLTALLRSESDYLQQSPCHAFEHAGADDKDDDGRQGNTFDFEAAADSSSFGAEESGWRSLSGYRDCEDLQSVAYAYLNHLS

SEQ ID NO: 553 - DNA, 3762 bp, Zea mays
gatgcctaggcggtatccagcaacagagtgtctctagcacgcatctcttactctatttatcaactctcccccgaatacatgtggttccttattgtcactggcggatctacagggtgtcaccctgtagtccggtaccggcataacatattagctttgtctatttcatgacttcaaacatgttgcaacaacctacagatgcgttcagtctatctatatacaagaggaagaatacaagtgacaaatctaatttgtgaatataagaattattatgctggtttacatagaataccaaattatagcacacatttatcattccttattgaatttctaaatgtatttcactgaattattcatgcatttttaatttggcataccttatagtaaaattctataaccgctactgcttattgtcattatgcgacttggaagacattttctacctactgaaagcggtctgttttttgtgttgtcgagagtgtgatgggtaaccatagttaataatgcactggatctatcactactcatacaggtcccatatgcctaataatgttgtgaagaccaactcatctgaccacatctgtccctaccatgcttgtacaccacactacatacatcactcatcactggtccttcgtttcggtaccctcctcccacaatgttcaatgtatatactaatagttctcaaataaattcctgtggatgttacaaaaacccacggtctttggtttcctgaagaagtatttcatggaggcgcgcacgtccatcgtactgcgtcctgcagctatggccgcccccatctggccaataaatgtactaggtcacttgtagccaatagcgtttcaacatgcacacagcttttcccccaatagtgcaggtccttgtattctcctccctctccctcacctcaaatctcatccacacgaacaggcggcacggcagtattcctccacagccctcctctctataagatggcacagccctctcaggtaggggcgagtgtctcactctcacatagtaaaaaaaaaaaacgccccaaggttcttaagcacaattctctagctatcttggtctcctacacagcctatgcacatgagcccatgcctctcctctccttgcgcctgcatagagaggtggtatgatcacctggaaagtttttaactctctctctctctctctctctctctctctctcttacaagcctagaccttatgcatggtcggacggacacatctgatcataggacatatgagtaggccacactcctcctgcccctctctcgtagagatcaacacacactgctcttagtgccaggacctagagaggggagcgtggagagggcatcagggggccttggagtcccatcagtaaagcacatgtttcctttctgtgattcctcaagccccatggacttaccgctttaccaacaactgcagctaagcccgtcttccccaaagacggaccaatccagcagcttctactgctacccatgctcccctcccttcgccgccgccgacgccagctttcccctcagctaccagatcggtagtgccgcggccgccgacgccacccctccacaagccgtgatcaactcgccggacctgccggtgcaggcgctgatggaccacgcgccggcgccggctacagagctgggcgcctgcgccagtggtgcagaaggatccggcgccagcctcgacagggcggctgccgcggcgaggaaagaccggcacagcaagatatgcaccgccggcgggatgagggaccgccggatgcggctctcccttgacgtcgcgcgcaaattcttcgcgctgcaggacatgcttggcttcgacaaggcaagcaagacggtacagtggctcctcaacacgtccaagtccgccatccaggagatcatggccgacgacgcgtcttcggagtgcgtggaggacggctccagcagcctctccgtcgacggcaagcacaacccggcagagcagctgggaggaggaggagatcagaagcccaagggtaattgccgcggcgaggggaagaagccggccaaggcaagtaaagcggcggccaccccgaagccgccaagaaaatcggccaataacgcacaccaggtccccgacaaggagacgagggcgaaagcgagggagagggcgagggagcggaccaaggagaagcaccggatgcgctgggtaaagcttgcttcagcaattgacgtggaggcggcggctgcctcggggccgagcgacaggccgagctcgaacaatttgagccaccactcatcgttgtccatgaacatgccgtgtgctgccgctgaattggaggagagggagaggtgttcatcagctctcagcaatagatcagcaggtaggatgcaagaaatcacaggggcgagcgacgtggtcctgggctttggcaacggaggaggaggatacggcgacggcggcggcaactactactgccaagagcaatgggaactcggtggagtcgtctttcagcagaactcacgcttctactgaacactacgggcgcactaggtactagaactactctttcgacttacatctatctcctttccctcaacgtgagcttctcaataatttgctgtcttaatctatgcgtgtgtttctctttctagacttcgtaattggctgtgtgacgatgaactaagtttggtcatcgcatgatgatgtattatagctagctagcatgcactgtggcgttgattcaataatggaattaatcggtgtcgtcgatttggtgatttccgaactgaatctctgtgatgaacgagatcaaacagtatccgccggtgacggacgttcattactattggcaagcaaagcaagtactaatgtaattcagctgtttgatgacagaatgaaaaaaatgttgaaggctgaagctataacatgctgaaagagaggcttttgctaggtaaaagtctagctcacaaggtcaattccatgatgccgtttgtatgcatgttaaaatctgcacctaatggcgcggctttatatagtcttataattcatggatcaaacatgccgatcatttagttgggttaaaagttcctgttactaatggtttatctaattgcttctattaacactaatttcttgatgagctgcaaatctgattcgttccttttcagactactgtatatctcgaattatctatccctaggttgacatcatttctcgtctgctggatgatgcctcatatatatatttctatgtgataataatcctggctaaaaaaactatattctgattgttttctgatttcatttttcgtcggtagaaaagatatttttagattctatcggcacatatccacagattccaaaggtctgcatgattattttatttcgtatagactatgaattgctacttgctatttgattggccatcgtgattcatgcacaacttactatctgactctctttaattaattaaacctttagagtgtatgttgaaagctaattttatttacgaccacctccatctcaaaataaatcaatttatagagctgtacaaagtaaagctattttaagtttgaccaaatttataaaaataacacaaatatttatggccctaaactattatcatcatttaggtattaactctatgcataatgtacttagtgtgatcgttgatgatttttaatataaataaaattggtaaaacttaagatagttttggggatgtagggccggggtgctagggtttctcataggcacatcaaatgtcgtccatgagttcaaatatggacgat

SEQ ID NO: 554 - protein, 376 aa, Zea mays
MFPFCDSSSPMDLPLYQQLQLSPSSPKTDQSSSFYCYPCSPPFAAADASFPLSYQIGSAAAADATPPQAVINSPDLPVQALMDHAPAPATELGACASGAEGSGASLDRAAAAARKDRHSKICTAGGMRDRRMRLSLDVARKFFALQDMLGFDKASKTVQWLLNTSKSAIQEIMADDASSECVEDGSSSLSVDGKHNPAEQLGGGGDQKPKGNCRGEGKKPAKASKAAATPKPPRKSANNAHQVPDKETRAKARERARERTKEKHRMRWVKLASAIDVEAAAASGPSDRPSSNNLSHHSSLSMNMPCAAAELEERERCSSALSNRSAGRMQEITGASDVVLGFGNGGGGYGDGGGNYYCQEQWELGGVVFQQNSRFY

SEQ ID NO: 555 - DNA, 9744 bp, Zea mays
aataggggaattttccgcggggaattggggatcgagtccccattgtcatctctactctgcgcacgtctggatggtcgcgcctggggcccgaacggttcacgatggcgcagagggtcttatttttcacagcagacctagatcttgcctctcgggagggatcccgtcggggaggagagatcctagggtgtgtcttggtgtcagcaggccacccaagacgcttctaatcgatgtagaaccgaagaaatgcgaagatttaaggtagaggaaggctaaactagagctactcctaatacaaaatgtaaaaacgataagtaaatttgatctgatcgaatgtgggggttcaatcggccgtagccctttatatatataaatgagagatctgaacccgttacatgtcgtttaccgagttaatctcgtagatttagctaacaaatcccacaagaaaatcgaaatcctaaccgattctacacacaagcggaccatccatgccatcaccgcggatcatccggcctagcgtcccctgcccaaaagtgggctcaacaagcctaaatacatataatttataccacgtgcaacacatttattcatccatatcacatgtcatgcaaggcataagcatcatgttaacttagttatactgacatacatttatgagttgagatgtccaggatgtgagcgcatgagcccattgtccattcaggaccaagacaggctactaagcactttctacataacttgtatgtgctaactatagcatgcttatatggctctctccaaagttcaaagctagctcaaatcttttgatttaataaaacttaaatttgtttgatttcagataaactgataatttttataatatttagagtgagttgaaaacagaaactggccgcaaatccacctcaagccttttgatttgacctaaaaaaaagaagcccccacaaacaccactccacactagtgcactgtctctctccaaaggcagctgcattggcctccagccttttccctactgtgccgcgcgccctcccttctctctaatgatagcatagggagagaaggcatactccgaggcatccttctcctttccctctccttccccaaacccttttcctctttccctcgccccaagaacttcatctcatctccaggcgccccttttgcgcttgcgcaggaggagctcacggggacagtgggcggagagctcgatcgctgcaccactacttcactggaggtccgcccactcccatggaggagatcacccaacactttggagttggcgcaagcagccacggccatggccacggccagcaccaccatcatcaccaccaccaccacccgtgggcatcctccctcagcgccgtcgtagcgccgctgccgccgcaaccgccaagcgcaggcctgccgctgaccctgaacacggtggcggccactgggaacagcggcggtagcggcaacccggtgctgcagcttgccaacggtggcggcctcctcgacgcatgcgtcaaggcgaaggagccctcgtcgtcgtctccctacgcaggcgacgtcgaggccatcaaggccaagatcatctcgcacccacactactactcgctcctcactgcctacctcgagtgcaacaaggcaagcaagactagtagccgcagtctaacaatagctctcctgcttccggttcagctactgctgctagcgaagtttggccacatctgatgtcaagagcatggcgcatgcacatactttctgcttgcttttacatagcatactatagtttatgcatgctgctcatgtagacatgtgcatctggtgttcggaactttctcaaacggccgtgggtgtttgcaggtgggggcaccaccggaggtgtcggcgaggctgacggagatagcgcaggaggtggaggcgcggcagcgcacggcgctcggcggcctggccgctgcgacggagccggagctggaccagttcatggtgaggcatctttaggtttatttcacgcgcgcgcagcgcaccattattagtcgttttcagctcgggctcggatttaatttgcgtgtatatatggtaggaggcgtaccacgagatgctggtgaagttcagggaggagctgacgaggccgctgcaggaggcgatggagttcatgcgaagggtggagtcgcagctgaactcgctttccatctccggaaggtcgctgcgcaacatcctttcatctggtactgaagttgctgcggcccatgcccctcttattttatattagatgatttcttggatcggttgtcgcctcatgcagcgatgcatgccctccctcttgttaaaatcttcctgtcctctccttcgtcttgctgtcctctttcttggttgagcatatgttgatgggtttttttttttgcatttcaaaagggttaaatttttccttgatgtggtttctcagcaattaattttggcatctgtgtagttccctttttaagagcatcttgctatgcatgcatattttgagtatagatagctgcggaacgcagatgaatgtcttgtctgcgcttcatgttttttaatgcgcggcagcattcctaatcaggggtttcgaaagagaatcttctccctgcttgcttttcctggccatgcatctgtgagattcttctctctggcttccgtcgatctttgcttctgctggaaaggaaatagtcctcagtcacacatgtgcaggagcgcagcttcaatctagcatggctgaaagctctctggttctttccatacactccatcctgcacattccttgcatatattctgctgttaaactgcttagcgacgaggatgaatgaaaacacctgtcttttttactagtgggagtactaatttggctgctgttgccatggatgcgttgttcatcgtcctccattatattgatcgattccatttggaatggaacatgtgcatgtgttctgcgagtagttcctggctcagcgcagccatcttttcccatgatgggaaccccagggagttcccttgttctagggtttgggaaagggccacagtgtactgggtgctgtggcattgtgcaagcacagtctatagccgaggagtctcactggcgtatgtcagtgaaacatagtagtatacacgttgtagtagtgggagatcagagagagagagagatggggagtcatcccccatctgtcacgcaagcttgtggccagaacattcttgtcatctttctccccctcaagagatgtagctacctgttgtcctagaatctatagtgttgtggtgtggtcttccaggtgcgcacacagatctggccactgctggccttagtatttgctaattttaaaatgaacacatcaggtagatcgagacgatccatggcaagcgtctttctaatgacctatcacaaggctatagtaacaactcgtaccaccacagttacgcacagcccagagtttttcacttctcggttctgttcttcttagagcactggctatggctagtatatatgcatggcagcaacacacacacacacacacaatcacttcattactggagcaagttagcgaagaagctgccatctgatgtcgtagaatgctgcaaaaatgaaaggttcagaggcaggcatacgggttgaaatggagcaccgtatgcggcggcccagttttttgtgttctgaccggcgcagtggacaaaatggcctgtgtgcctcgagaaccatagagacagttgcctagcgcatgagcgctgagcggcccctattatttgatgtgagatctctctatcaatggatgtgtgatctgctaggtttatattatatatgcgtctactatatccctaccagtccctgtattttctgacagatagacttctcccccgcgcgttctctcataaataaatgacggtcaaggaacattggatgctttccgaggcgagctagtacaagtttcatctgcgtttgcgtttgtatttttcagctgtcaactcagatttctcctcagctccaactgttctttgaccttcttggtactgttttcttggaagaaactatttgttgaccatttttggttataataaggccacagacaaactgttgaatttaatcacaaaacaacactactgcgttttttcttttcttttctgactgatgttgcacatgtactccaagattcttggttgcatgcactctttcaaggtcatgcaaaagcagggacaccgggtgtcacgagtttccgtttgtctcgaggtaagaccaaaaaagataccggaagcaaacaacataaaacaaagggtaggatggaaaagagctgatggattttacaatgtatcgccagagtggaaaagacaacgcgactagaggaaaggaacgatctggcacttccaactgtgtgaattcttccatttgatgtgcgtctcgtgcatgtttattttcttggttactggaaatcgggtgcatccatttttattcaggattcaattattggttactggagccaggtccgttcgtttttattttccttttgagattgactggatcgattctctggttctagtcacttatgctgttggttttatcgttttcatggatttctattctatctctcccaatattcagtatcacataaaatcctgtgactagatttctttatcacatacaatcttgtttttttattttctttaatttaacactggatttgtttgataatatgttctgaaaaacgttaataaatttaagcacaacagccttttaaaaatatgtataattatttaccttgaaacccagcatcggccgggaacaaggaaaagaactcaaggttttaaatgcattgaaatgaaacattaatggagtgtttggtttgaataatgatgtagtccatcatcttctcactcctcacttttttgtttggtttatggaatggagtgagttaatccatcaacacctcattcctcatagttagttgtttagtactaatatgtggaatgaagtcatcccaccaaatttgaagaatggactcatgatgcaccacttcattttagatagagtgattcatcaaaccaaacacctcataagggcatgtttggatcctaggagctaaaagaaaagtgactaaagtttagtcactttaggagctaaagatctactaaataggaaactaaaagtgactagaatagtaaaaggtatctttttagtcatttttagctcctaagaaggagctaaattttagttagtttggtttagctcttggatccaaacaggccctaagaaaatgtttcgacaacatttgggacaataaaacagttcctaaggatttctttggcaagattaggccttctttggaacaaagaaaaatgaaggaatcttgaaggattgaaatcctataggaagctttcatatgcaaagaattgtgttcctaggatgatttctaacaagaggctcatccccttgaaaattgttctttgtgtctatctctctcctctaattcatgtgttcttatgttgcattgaaacactattagaaaattttcatgtgttttaatttatgtatgattgtaagtgtcaagcagcactattcctacattttttctattcctgtgttttatcgatactgcatcccaatgaaggcctaagcgtatcatgcaatcttttccagaagttttttagattgctgtataatgacaaggtgcaatgctcttcgttttcttttttggttttcctcattttcagcaaggccaccaaatttttccatgatgttcttgtcttattcctgtagtatccctcgaaaaaatttcatagctttctacatccatgttatctaatgatgttcttcatttcaaagacagacacatttggcataagttctgattggtcactaaaactttgtggtacggtcatttacttttactatacacatgtactgtattcatgcgtacattgtactttgtccattggggcctttcctctttttaatacaacgggcatcgtttcaaaaaaaatgtgtcagtcgtaactgcacacttctttagttttccccagttaacagcatgacggaatagagttacagagtctcatgtcaagtcacatatatcctcaagtcgtttctaaaattaaagtaatattttcattgttgcttccgtaagaatgcaccacaaacacaaaatatcatttcctttatgcaaatatatatatatgaatgtttgtttctggcagtggtgagaagcttctcactgagccaaaggttttagggatgccatgtgctctttttcttttttaagtgtagattaagcaaacctttataatttttaaactccaaccagataccttttctaaattcataaatgctctggactatcttcacgaaaaaggctttggtaatatgttcacaagcctcctttatctgttatcctgggctagacataggatgtgttgaagcaatacaagcggagttgtttcgttaaagcaaaaaaaaaactgtaactttatattggagaatatacatcgttctcccatatttgttacagtgctcataaatagacaaagttttttttttgaaatcttaagccctgtgtttctttggttatcttatctctatattgcttccaaatatgttgtcatcaagatggatatagataattgtcaaaacgaaaagtgtgcatggttcatttatgccaattctgaaaagcataagttaaatattaagataccaataaagaaaaacatatgcagtgttgactgttgggaaaagaacaaggtctgcacatacacttgcaatataaatctttttacccagcaataaaaaaacgatcaaatatcacgcaaacaaagtaatacgtccagaaacacccatacttttgaaattcgtctttgaaatgcagtaggttcacaaaataaaatggtgcaactgcacatgtcctttatatctgtactcaatgggttttctggagatgttagattgattggtgggacaatatcctaatgcaactcgcaaattcccaaggccgaactcaagtgggagtttggatgattttttttgtaaagaagcagatggctgcgctagtttacatagaccatcacacttcacaattcacattcatgaagtcataactttgttcacttcttgtttaactatggcatataaaaacatactgtgtgttgttttgcttgtatggaacatgtattttagttttttagtaaataagttcagtaaatgtctttgccggacaaatttcaccaatctggctacgaatgatgcttgatcacttcttttgttttatctaaaagttccatgtcttatgcttgaaggctcttctgaggaggatcaagaaggtagcggaggagagaccgagctccctgaagttgatgcacatggtgtggaccaagagctgaagcaccatctcctgaagaaatacagtggctatctaagctcgctcaagcaagaactgtcaaagaagaagaagaaagggaagctccccaaggaggctcgccagcagctccttagctggtgggatcagcactacaaatggccttacccctcagtacgtcttctttttattcttccattttaactattgttggtgacacatgatttagacgatgccaattcttcatgaacttttcatagccagctacccaatgttagtactgactgcacattgtaattcaagggtaagtatatatatacataaatcacatttggcaaatctaagctacatatgggtctttgatcttccatgacggtctgttgatctctgatttgcatatcggcatataaaaagtgagccaaaatatgtcagagtctaataatattgatcagggagtggcaggtgattattggtattaatttaaccttatttaaggtattttgaaacttctgtagcgttcttactaaataccattgattttaatttaagcaactatatatttatctggtgaaaaatgaagccttttctgatatacaaattgaagagtctacaatggtttcacttacatggctgaaacagaaaatcatagtgccctgaattgtgtgttgatactcataagcgcagattcaaatttgtaattttcaagtttagggttctaagtgaaaaaaaaacattgagtccaggagcatacactgaactttttttttatcatatcttcattttgttggatgttttgtatacggcatatagcctgtgcttccctactggatatgaattaaccaactcttcccatcggtgagcaggagactcagaaggtggcactggctgagtctaccgggcttgacctgaagcagatcaacaactggttcatcaaccagcggaagcggcactggaagccatccgaggagatgcaccacctgatgatggacgggtaccacaccaccaatgccttctacatggacggccacttcatcaacgacggcgggctgtaccggctcggctagccaccggtatctcgcttccatttcacaccccacggcctagctataaagactaatggttccaggtgtctgaagtactgaagacaggggggctagctatctaatgtttgtgccgcacgcatgagctgtaaggaggccatgcttaattattctgttgccgttgctactctatctatatgcgcctatgcctccgtgcatgaactatgctttaggtggttgctgctccacactgtggtggtgtgcttttgcttttgtgtggtcgtattgtatgcgtaacctgacagatggatccctgattgctacatgtttgaataatttgcatgatctagctagtttctgcctaatctaatggtacggctcatgtcttgtcaggtggatttgttatgtgttttttttttcaaattgaggcttgtttgttttgctctcaatccatccatgtgaattgggtggaattaaatgagtttaaattccaaagtcagtcaaaatctgttataattcttccaatccataaccgaagatcataggccctgtttggaatccctagaactaatagttagctagctaatatattattagtcggtatgagccggctctaataaactaattgttatttgtgagataactaacaattactaatagttagctagctaatatattattagctggtttgagccagctctaatacactaattgttatttgtgagataactaacaattaattatgatattagctgatgatgtttggaacctaacaactaatttttaattttatttctataggttctaaacaggaccttagtggctagtttggatacactaaagtgtcgttcggttgtttgagatcgatggatcgaaacgattactaatcagattacttctctaatttatataaactttgattagctaaaataatttcgggcgcaatctggtacaaacgaacaagccctaatcaggatggcatgccaatttggattggtgtggggtcacgcatggtgaattatgaatcatcctgggattgtttggatgcgtgtgtatttacatcaatagtttggcgtggatttgaaatttcacttgtcgtccacctcagacatcaggagaactcgagtgaatagggagattaatatttgggtaactaggcgagacgagccaacgagtccactaccaatgtacttttcaaaaaaaaaactacgaagggtgagtaccattctgcacgcaccagcacgccagcaccagcatctactcgacaaggagacgagacgaggctgggtttgcaggagaggctttacgagtttacgcgatcgggagcggtgccgcagtccggccggccggccaggaggggaagtgaaagt

SEQ ID NO: 556 - protein, 359 aa, Zea mays
MEEITQHFGVGASSHGHGHGQHHHHHHHHHPWASSLSAVVAPLPPQPPSAGLPLTLNTVAATGNSGGSGNPVLQLANGGGLLDACVKAKEPSSSSPYAGDVEAIKAKIISHPHYYSLLTAYLECNKVGAPPEVSARLTEIAQEVEARQRTALGGLAAATEPELDQFMEAYHEMLVKFREELTRPLQEAMEFMRRVESQLNSLSISGRSLRNILSSGSSEEDQEGSGGETELPEVDAHGVDQELKHHLLKKYSGYLSSLKQELSKKKKKGKLPKEARQQLLSWWDQHYKWPYPSETQKVALAESTGLDLKQINNWFINQRKRHWKPSEEMHHLMMDGYHTTNAFYMDGHFINDGGLYRLG

SEQ ID NO: 557 - DNA, 5660 bp, Zea mays
tcgtaggtacggtcgacctccatccgcgaactccttgtcatctgtgccgtacctatgtgcgcgcgtgatgggatcgtcagagacagctgttgtgcacggaattattaaggcctcgtttatttgtccaggattgcccccaacaatcatttaaactgatcagagtttacactccgttcggatgtagatattagagcacaaaattaggaattgagattaactttctaaactctgttgtttgatggaattcagatttagaatcagagacctaattttctgaaattggactataactagaaagttactctcacaacagagagcgtcaccctccactgtattacttgaaatttgaccgcacaattcggaatagctctatccatttttataggtgaagcggcaatgttgactttcttatcgtactgttatatctttatcctaggcagttgatgagatggccttctatgtgctcttctcataccccagctagaacacatgtcttgtttaggttatcattcgtcttgctgagcttttcgataatggtataaccgtttagaaattttacaggtactggagtattatggtggctagatttgaagttcaataagtgactgattagcatgacaaatttagaggtgtccgaaagatttaactctttacacgatggaatatataactagcactgttaagttgatatacatagatcactacaaatttggtttatgacttagactattaaaaaatccgtttaaattttattctaaaagatcagagtaaacaaatatcttaaacatcaacagccgtaccacgaggaaggaaaccgagcgagcaagcagcataggcgcgtagccgcgtggaacagtaggaattgcacgagaaaagaggagcttggtggtgcgggactgcggggtgcggtagtggcggccgagctgttggtgcctgagacgtggaggagggagccgagtgggagtgggattgcgtgtgccacgctggtgaggggacgagaggagggaggaaagggacggcagcacagcacacaggcgcacacgcgcgcacactgcaccagacacgccaaaagcgttattttaagggcggcgccaccactattgtcgcctgcttcaccctccctgctcactgccgcctaccctcgttgaagcgcgctctctcgctctcgctctcctcgcgcttcctcccactcccactggacagagaggagggttagtggagggcggggtaggaagctaccgccgccacagtaacagcgttagctaggggggaagcacggaagcgggaagcaatggcgaccggcggcggcagcagcaggagcgacgacgtgcgcgggctcaagtttggcaagaagatctacttcgagcaggacggcgggagcgggagcggggcgggggcggtgggcggcaggaaggggaagggcgtggccaccggtggcgcgaggccggcgtccgccgcctccgcagcccagccgccgaggtgccaggtggacgggtgcggcgtggatctgagcgccgtcaagcagtactactgccggcacaaggtgtgcaacatgcactccaaggagccgcgcgtcttcgtcgccggcatcgagcagcgcttctgccaacagtgcagcaggtaaaaaaaaaatttcgaaccagcagtcattcaccttcggttgctctcagcagtactagcaccccaaattgggttccgaaaaattgcgcattccagtggaccaccctgcttcggcggcctactattcggctcgtgataccttgggaactacagtgtcgtctcgtcagtagctagctgaattcgtgaccacatgttcgcacactactgctatcttcatcccactcgcttcaacttagaaacaacgatttctgacgatttccaagcatccaactactgtatcttttaaaacatgcttgcaggcgagttcacgaattctaacatagcgtagcatccgtccataaatagttggatgctatgctgggagtaccgttggtggtgggcgtcaaaattgatgtaaacttcgggcaagtggaatctgaccagaatagtaagggacatagatgtgagcattcacagtatcttgtctgagcagcacggatatagcaagcctagatttatctcttttttttctctttattctactataggtagcctatgtgaacgcctattggccagtgcagtactacgcctgtgcctgtacggcactatttaccgaccttaaatgagatggagcaggagttggatatgaagcaaacagggttggaacaaaacaaacatagtggaaaacggaatgtggtgatgctgaaaaatgcatatggtccatgtttgcaagctgataacgtcgcctttttttttctaattaagaatctgcatcaagtgttgtatagtgtaaggttgcacgggcataccatagcatagtcctaaaatgccgttgcttcgttgcattatcttgatgaactgtttggaggggtcggggtagggttagggtggggtgggggagggcgtgcaggagccatactcacattgtctctagccttcggcatcaccggtaaagggaaggttcgggccgttcgttgatagatatataaattaaaggcctgtttggtttgtgactaactatgtctcactttatttaaggttaatctgtctcactttgtttaaggttaatcgttcgaattgaagaactaatcttagatagaaaagttagataaagcgtggcaaattaggtagcaaaccaaacatgccttaaacctcttgtttcattgataaacacgtcactttacaaaggctctacgcgtgtccgctccccgtgaatgattgcaggtgctcttcccacatggtaacctttcaaacctttttccatgcatatggggccctgatgtgtggatctaatcatgaaagctgttgtgtctttggttaatatcgctatacacatacatgtactttgaataaaactgttagttcaggaggattaggaaaggaaaaaaaaaacacatacacgctgctgcttgtatggacgcacgcggcttttcacatgacatctgtgtttgatattgtatatttgttcatctgaggcaagttggtattaagatataagctaacagtatagcagggtcttgattaccgagttaacaattccctctttccatgtgctatagaagtataatagtttttctacattgctgttgatccatggatattcctttagtctgttttttttttgttttgtaaaactaattgtcctgtgcaaatctcagtgctgattatagattacaactggtgacatgactcgttttttcgttatcagtggtctgatttatagatgctactatttgttttcccaacattgtttttgggttgtgaatgcacgagccgttgacctactactattggtcgtctttgaccctgctttgattagcgaattcactcgttgagtctgtactgtgagtgaaaaacctgttccctctaatcacaggttccaccagctacatgaatttgaccaagggaaacgtagctgccgccgccgcctcatcggtcacaacgagcgccggaggaagccaccacctggacctctcacttcacgatatggccggctcgctgcatcacttcaaggtatccagtgctgcaccttgttagtagctgtacaccgatgccatgctccatcgttactaacccgccgtttctcggccaatctactgtttcctcagagcctggcaggttcagaagcttcctgctcgacttctcgtacccaagggttccaagcagcgtgagggatgcgtggccaggaatccagcacggtggcgacaggatgctgggcaccgtccagtggcatgggcaccaagaacctcctcacccacaccgcagtgcagctgctggctatggcaaccatgctgcatacaactgccatggcggcttggtagcaggcggggccccaatgctctcctctgccgcctttgagctcccgcctggcggatgtgtcgcgggagttgccgccgactccagctgtgctctctctcttctgtcaactcagccatgggacacgacctcccacgaccaccggtccccagcaatgcccgcggccggcgccttcgacggcaccccggtggcgccgtccgtcatggcgagcagctacgcggcgtcgagcgcctggacgggctcgcgggaccccgctgccgacggcgccaggaacgcgcagcgtctcgacgatgctctgcacctggtccacccaggctccgcggcggtccacttctccggcgagctcgagctcgccctgcagggaagcggcgggccgccacacctgccgcgcgtcgaccatggcggctccggcggcggcaccttcaaccattccaccaccagcgcgatgaactggtccctgtagcagcactgcctgccttcatccggtcgccacgccacgagatgtggagggagcacttttgcattggacaccaccctggttttgtgcgccttaccttgccgttctcgttttttcagggtggagaaactgggattcctaaccatagtagatctaccgtgaattcccttcccgtgtagtagcgcattgcgtccatgaactcatttgatcgatcgtcgtgtcaccgtgtgcgtaactgcgtatctgtttggcgtaactgcgtatctgtttgttgaatctttccgaacattgcggacttcccatgctgcttcaagcaacaactcgggctataaatatatcgtactactggagaacctcggcgagctggtacggccgcgatgagttcggcagacaagacgcatggttcgcacggcgcgtggtctgtcatcgacgaggcgttcatgaaggctccgccgtcggacgacccggcttgctccgtgcaggtggacgctgtcgcataccgcgagaccatccagacctgggtggaagacctgcgcgccaagaacggggcgcgcccgctctcagcggccatgtaccgccgccggcgcgccctcaaccactgcagcgtagctctcgagttcgcccagcggcgcagggtggcggtgggcctggaggacgacgagctgtgccggtccgtgcaggccgcgatggacacccaggtggtcggttcgtgcgcctactgcggctgcaatttctccgtcgtggccgtggtcgccgtggggggcctgggcatggcctgcggcgtctgtttccggctggttcgagtgtacaacccggtgccgctggttcgcaaccccccggcgaacgcggaggagaggtggaagggctggctgccatggtaggcgcggcagccacgaaggacgcctacgcgattttcatgatcagcggaaatgtagcactgttctaacacacatctgatagactggttattttgcagttctattagtatttttttagttaagcaatagattgcatagattgcaacgaaccgaatttagaatgttagcaatggtcgtccggaagaaggcacctgaacgatttccgttactgaacagatctgtttaggtacattagattaaacttttcgtttggctttaatccatactcacttatactgtttctacaatgtttttgtctctatagattgcagcagcagcagtagtctaaatagccggctttaatctgaagtgaatactgttcgctgtagctagattaaagctgctcggaccgctgcaacgacaatctatat

SEQ ID NO: 558 - protein, 378 aa, Zea mays
MATGGGSSRSDDVRGLKFGKKIYFEQDGGSGSGAGAVGGRKGKGVATGGARPASAASAAQPPRCQVDGCGVDLSAVKQYYCRHKVCNMHSKEPRVFVAGIEQRFCQQCSRFHQLHEFDQGKRSCRRRLIGHNERRRKPPPGPLTSRYGRLAASLQEPGRFRSFLLDFSYPRVPSSVRDAWPGIQHGGDRMLGTVQWHGHQEPPHPHRSAAAGYGNHAAYNCHGGLVAGGAPMLSSAAFELPPGGCVAGVAADSSCALSLLSTQPWDTTSHDHRSPAMPAAGAFDGTPVAPSVMASSYAASSAWTGSRDPAADGARNAQRLDDALHLVHPGSAAVHFSGELELALQGSGGPPHLPRVDHGGSGGGTFNHSTTSAMNWSL

SEQ ID NO: 559 - DNA, 4391 bp, Zea mays
tgttaggagttaatgagtataatgttttgagcatattttgacacctacaagtaattttttctatatccttctttatgatatactatacttgaaagaagattgaattaaaactaaaatctctctctcaagttgaattgttgtgccacatctttcactaatttataattaaagggtctcatattttttgtacttttttataattatatttaattgtaaatctcataaaatattgttagctcgtgtcatcaaatcactaaaatccataaataggattgatgcacttagctctttaaaatgaaaaaggtacaaaaatataaaaaaaatcgtgaaccccccaatcaatttctaattgcattgtgaaaacttcgacaacaaaaatataagataccaccaaaataaaatagtatcaaacaatatcatcctctatttcaaacttctttatgcaagcagcgtcattcacaatttcgcgtcctctattttacacactgtactgcagacaaccttaacatctatgttggttgtatcacatatttttgttgtagaaaatttccaaagcacatttaaacttgattaaaatattttgggggtttaacgatatttttttattattctagaactaaatatatttttaaagcttatagatatattttcgcgggctctaaatacttttttctccggtcccaatctatttctaatatttttgaactttttatatactttcaatgttttaaataaactttttccgattttcttagtaaaaagttgaaaccatcctaaaataaaaactatttctaaccatggtagagagctaatttaagcggctttaagatttgaagaagaaattgccttattttagagttcattcaagaaggaaaaaatggagtcctagttgagggaaaacaccacagattccacagccttcgcctgttcgccacctttcctccaaaatttgacccacacgcggcgacgcccgaggccccgagcgaccacatcctccgcggccgcggcgacgcccgaggcctgcaaaaccctaaccactcaggttctgccggccaccgccaccaccaccaccagtccaccaccatgctgacagccactcccctaccccatcagctcctggccaccttcctcctcgtcctggcgtcggcgacccaacctgcagtccctgcctccaccgaccgcgcagcgcttctcgccttccgcgcgtccctgtcgccgccctcccgcgccgcgctatcctcgtggagcggcccgctctcgccatcctggctcggcgtgtcgctccaccccgccacggcgccagccccttcggtcaccactccctccgttgccgaactctcgctccggggcctcaacctcacgggcgtgatccccgcggcgccgctcgcgctcctccgacgtctccggacgctcgacctctccgccaacgcgctttcgggagagcttccctgctccctcccgcgctcgctcctcgcgctcgacctctcccgcaacgcgctctcgggggctgtccccacctgcctgccgtcctcgctccccgcgctccgcaccctcaacctctccgccaacttcctccgcctcccgctctccccgcgtctctccttccccgcgcgcctcgctgcccttgatctctcccgcaacgccatctccggcgccgtcccgccgcggatcgtcgccgaccccgacaactccgctctcctcctcctcgacctctcccacaaccgcttctccggcgagatccccgccggtatcgcagccgtacggagcctgcaggggctttttctcgcggacaaccagctttccggggacattcctccggggatagggaacctgacctatttgcaggtgctggatttgtcgaataaccgattgtccggttcagtgcctgccggacttgcaggctgcttccagcttctgtacctgcagcttgggggtaaccagctctctggggcactccgtccggagctcgacgcactagctagtctcaaggttctagatttgtcgaataacaagatatctggggagattcccctgccgctggctgggtgcaggtctttggaggtggtggacttgtcaggaaatgagatctccggtgagctcagcagtgctgtagcgaaatggctgagcttgaagttcttatcactggctggtaaccagctctccggccacctacctgactggatgttctcgttccccctgctccagtggcttgatttgtctagtaataagtttgtgggtttcatcccagatggggggttcaatgtcagtgaagtgcttaacggtggaggtggtcaggggactccatcagagagtgtgcttccaccccaattgtttgtgtcagcttctgtggacacggtgtcatggcagttggatttggggtatgatgttcaggcaactactggtatagacctgtctgggaatgagctctgtggggagataccagaagggttggttgacatgaaggggttggagtatttgaacctctcctgtaattacttggctgggcagatccctgcggggcttgggggcatggggaggttgcatacgcttgacttctcacataatgggctgtcaggggaggtgcctcctggaattgcagccatgacagtgcttgaggtgcttaacctctcctacaatagcctgtctgggcctttgccaacaacgaagttcccaggagcattagctggaaacccaggaatttgcagtgggaaagggtgctctgagaatgcaaggactccagaagggaaaatggaaggtagcaatcaccgcggttggcttggtggctggcatggagagaatggatgggtatctcttggtgcattttgtatcagcacaatgactagcttctatgtatcattagcaaccttactatgctcctctaatgcaagaaacttcgtgtttcggcctgtgagggttgaatattaacaagaggggagattgcaaaatcaggttgttttgaagttcgagcgactctggtctgcagctgattaacaagaaatatgagcatatgagatggatatcttcagccaagaggaagtgctgtctcttttaatgatcaatcaagctctcttgattgtttcctaatattcttgatcttgggatgtgtagatctagttctaatattcctactgttatagaatgcaatcacctgctggtgcttggttgtagccctggcgtgtttggaggattggacaccaaggatgcacataatttgaagcgctggtactgtgaaccacttcagatgtaaatattttctttggtttttagttctgatctagtttaaaactggacatgtatttagtgttgttgagctacctttcgatgttatattatgtcaatttgctggaagatcatttgataacaattgtctaatccagtggattagtcgtgtagattgtgaagttcgttatgtttcttcttagtgctatgtatatcatctttctgtctgaacttagtttgggggtaaaaggctttgttattatgtgactgaaactgcaaatgtgcttgactatttcttggtgctgctcctgtaacacctatagttttataggtcaatggtaatagctgcctgaagcagcatccagcaggccggcaactgtttttggtactgtaatactttggaacagaggcgcaaagtttgtgattgcagaatgatcaacaaatgtatttattgcaaagtgtgagacaaggcaacatacatatctctgttttgtgcattaccaaactaacccaggctgtaattgcagattgataattcctatagccgtagcttcttcagctggataaggtggagaataagcatcagtggcttttcaaagggttcggcacttgtgcagaatcagactcatgcaggaatccggttctaacttttccactaaaacctttttcctttctgaacttgctgcagtacctaccactacttgtaatgttggatcagtttcacagttaaccacagaatttcattgcttttaatcaaacgtgaaatggtcacacagaaaaaccaacatccttcagaaccgctcgttttatcttgttctttagattacttcaaatgtgagcgctttgagatggtcacctaaggtgtgtttggttgatgtactaaggtgtgtttggttggatgtacaaagagtgatggaagggggcaacaacagtttctatagtgtttggatgagtcacgtgaggacgagataaacattagagtaattttttatggcggcgtgatcccaaaaaatcgagggaacggtgttattcctgccttatcctattttgatctcaaaccaaacacatcctaaactgtcttggatctagataaggtgacctggacgcaaacgacgactgctgatggttggtctcctgtcaggaactggctcgtctggcctagacaaaagaac

SEQ ID NO: 560 - protein, 613 aa, Zea mays
MLTATPLPHQLLATFLLVLASATQPAVPASTDRAALLAFRASLSPPSRAALSSWSGPLSPSWLGVSLHPATAPAPSVTTPSVAELSLRGLNLTGVIPAAPLALLRRLRTLDLSANALSGELPCSLPRSLLALDLSRNALSGAVPTCLPSSLPALRTLNLSANFLRLPLSPRLSFPARLAALDLSRNAISGAVPPRIVADPDNSALLLLDLSHNRFSGEIPAGIAAVRSLQGLFLADNQLSGDIPPGIGNLTYLQVLDLSNNRLSGSVPAGLAGCFQLLYLQLGGNQLSGALRPELDALASLKVLDLSNNKISGEIPLPLAGCRSLEVVDLSGNEISGELSSAVAKWLSLKFLSLAGNQLSGHLPDWMFSFPLLQWLDLSSNKFVGFIPDGGFNVSEVLNGGGGQGTPSESVLPPQLFVSASVDTVSWQLDLGYDVQATTGIDLSGNELCGEIPEGLVDMKGLEYLNLSCNYLAGQIPAGLGGMGRLHTLDFSHNGLSGEVPPGIAAMTVLEVLNLSYNSLSGPLPTTKFPGALAGNPGICSGKGCSENARTPEGKMEGSNHRGWLGGWHGENGWVSLGAFCISTMTSFYVSLATLLCSSNARNFVFRPVRVEY

SEQ ID NO: 561 - DNA, 3169 bp, Zea mays
cacacaacgcaacgctcttatgtagtaccacactgctagctgaaaaaagtacaagcgaccggatgagctataaaaaaagaaatcagatttcttttcaactcatatctttcttaccctgttggctaagataaaatctaatatttattcgtaccagtttaatatctgatatgtttttgtatgaaattatttttataggtatttttttgtgaagatcaaccacattgatttactaggccctcgcatatcgcttagtcacattgcattgctggtagggtcttttccaccccaaccggtagcatcaaataagattaaatggttatgggtcttttccaccccaaccggtagcatcaaataagatcaaccgttttttttggcatgaattcgagctagagccatggcaaagagacctaactaactcatgtatgttttcttcgatcgaaagtcgaaagttaggttacttgttgttgttgtgagtataatataaaaaaaatataattgacacgcgcgtacagtataaataagcatgcagtctagctggggcacgatggccgacacgaatgaaacacgtttgtttgtccggtcgactggaagcacgacaaggccgtgctgctgaagcagccctgtggcgttcggcggcctactaagagcccaccacgcggcccttggcagcttccgtcccctcctgatgaaggagaaggagatgaaagggaaaggagctggattggattggattggatagatatcgtgtttatttgtttgagacggtagttttcatctaaagtttattcttcgtcacatgggatggccgtttgcttgtttgttgcttccgggaggcggtggtgaattgaagcagatcgacaagcatggctgcccactggtctcgatcgatcggcctgccatgccatgccatgccactagagtccgtcctgactggccgcccgttcccccgtataaaaaggcaggcaggcaggcagagcggggacgagcaagcaagcagttgcagttgcagcggcctcctcctctgcttcctccctcctcctcctcaccatggtgctggctgcgcacgatccccctccccttgtgttcgacgctgcccgcctgagcggcctctccgacatcccgcagcagttcatctggccggcggacgagagccccaccccggactccgccgaggagctggccgtgccgctcatcgacctctccggggacgccgccgaggtggtccggcaggtccggcgcgcctgcgacctgcacggcttcttccaggtggtggggcacggcatcgacgcggcgctgacggcggaggcccaccgctgcatggacgccttcttcacgctgccgctcccggacaagcagcgcgcgcagcgccgccagggggacagctgcggctacgccagcagcttcacgggccggttcgcgtccaagctgccctggaaggagacgctgtcgttccgctacaccgacgacgacgacggcgacaagtccaaggacgtcgtggcgtcctacttcgtggacaagctgggcgaggggtaccggcaccacggggaggtgtacgggcgctactgctctgagatgagccgtctgtcgctggagctcatggaggtgctaggcgagagcctgggcgtgggccggcgccacttccggcgcttcttccaggggaacgactccatcatgcgcctcaactactacccgccgtgccagcggccctacgacacgctgggcacggggccgcattgcgaccccacgtcgctcaccatcctgcaccaggacgacgtgggcggactccaggtgttcgacgccgccacgctcgcgtggcgctccatcaggccccgcccgggcgccttcgtcgtcaacatcggcgacaccttcatggcgctctccaacgggcgctacaggagctgcctccaccgcgccgtcgtcaacagccgggtggcacgccgctcgctcgccttcttcctgtgcccggagatggacaaggtggtcaggccgcccaaggagctggtggacgacgccaacccgagggcgtacccggacttcacgtggaggacgctgctggacttcaccatgaggcactacaggtcggacatgaggacgctcgaggccttctccaactggctcagcaccagtagcaatggcggacagcacctgctggagaagaagtaggcatgctatttgggtatggaagatggtggatgtaagcaaacaaagccaaattaagcagagtaggttaattaaggttggctgatgatccatttagggaaggagctgatctccctgactccctcctccaattttctcaaccaaatttatatagtataataataataataaaatagcaagtaatagttgtatcgtattattattaattaatttattagctggtaggcaagtagtattaaataccatttgtagtacgatgggcgtatttctattttggcgttttgctctgtgttttttgacgtttcctttggatttggggggacctcagatcagctcggcctgctacactgcatgcatgctaccatatcataccatgccatgccatgccaatgccataccccgcagcagttgattccatccatcactagcttagctacctgctagcgagagcccagaaattttatcctcgagtcgatcgagacctgcccatggattggaagaaatgtcaaattccatccaaacgctgtcgctagcaaatggcgtcgctgatgagtgcatccaaacgctgacgcccgtgggcacctcttttccatgttgagggtgttgcattgctctgtctttcatggacgaaagcccgatccatcttggacacgtgacggtggcgttctagaggtcattcccttctgaaggcgtcatgttggagttgtctcgacctcaacattgccttcggttgatgctttcgcttctcgacgtctcgattgcgggtggaggtgtggttttttgtaacgtgaagtcgatgctgccgcattaggggatgtggctcgacaacgatgacatgaggcgaacccccttccttgtggtctggattgttttgaaggtcgcacaaaaaaacagaagtgggtggtggatcaagatcgttggtgaagaatcgtagctgcctcgagtggggtgtgttgaggcttggcaacgttggcgtgtcgcggtcttcctccttctgtgacagggttta

SEQ ID NO: 562 - protein, 371 aa, Zea mays
MVLAAHDPPPLVFDAARLSGLSDIPQQFIWPADESPTPDSAEELAVPLIDLSGDAAEVVRQVRRACDLHGFFQVVGHGIDAALTAEAHRCMDAFFTLPLPDKQRAQRRQGDSCGYASSFTGRFASKLPWKETLSFRYTDDDDGDKSKDVVASYFVDKLGEGYRHHGEVYGRYCSEMSRLSLELMEVLGESLGVGRRHFRRFFQGNDSIMRLNYYPPCQRPYDTLGTGPHCDPTSLTILHQDDVGGLQVFDAATLAWRSVRPRPGAFVVNIGDTFMALSNGRYRSCLHRAVVNSRVARRSLAFFLCPEMDKVVRPPKELVDDANPRAYPDFTWRTLLDFTMRHYRSDMRTLEAFSNWLSTRSNGGQHLLEKK

SEQ ID NO: 563 - DNA, 2124 bp, Zea mays
ggccggctagcttttgtcttatactatatggtttacaatataatgatgtatataaataatgtttctcaaagctatagtattttagagttgttgaaaactacgatattatcgtgacaattgtaacatagtatagtattgtaaaaccatggttctgagaaatattgttgtcaaaaatgctcttatctagttcatgcatggcatgtctgtcctacgcatgcaggaagggaagggatcaagatggaacagagctagctatgggtatcccactcactatctactgctaggtggtgccaagaacatataaaattcatctctactgttccatcaacgggccaattgcggcatcttcctttttattccattcaaacggggaacgcatgtagctagctcaagtacactacatcctctcttttcctctcctataaataccgtaccacccccttgggaactcaccacccaaataagcataaatagtagtggttgattgtgtaattccagagatataaacgaatatctctagagatctgcctcatcaacagctgcagtatttgctagccacatatatatacacagttcgacacgtagttataacggaagagagaagcaaagagagaggcagagtgactgcaaccatcagtagttctatgattttattttttaccgttttgttgctgtttcatggtgtttatttgattgtagggtggaggagaggtgaaagctgacagaagagagtgagcacacatggtgcctttcttgcatgatgtatgatcgagagagttcatgctcgaagctatgcgtgctcacttctctctctgtcagccattagaactcctctatctctcaatctcgatctccctctttctttgttgatctctcccatggtgatatttatttgcttcctacgtgttgtgttctctttcttcagcacacacacaacctgttcatgttaccttagggttaaagtttttgcactttgcgtgaagatggaaagacaaacagtagatgagttttttgaaggtttgacagaagagagtgagcacacacggtggtttcttaccatgagtgtcatgctaggagctgtgcgtgctcaccctctatctgtcagtcactcatcaagcccatctgtcttattagcttgtttccgctgctaataaatattctagactcaagtttatttgacacagagatcgatcgctatcttgttcgatgcatatatatatatatatatagaagtattatttacatgtgcggatctcgtgtatatcttcttcctgattagctgatgatcttattctcatgtgtagtttatttgtcttcgtatctaactttttcgcaggggccaagccatgattgcgaagaaaggaatgtaaaagatggctcagaactccatcacaaagtctacatacggtcgaaataagatctccatcagatcggagagctttatttattgattgtttttttagagttctagagcaaagcccatgtcttagcattaccaagacaaaagaataatccatatatatatcctttggatggttcacatccttcactccaggtttaagtttaaccaacacaaataaaaatatataattaaacgaccggcacatagagacaaaaactcaaatctccaagaacatctccactgtcagcagcctccaaggtaaaccataaattttcaatggaacgatcatcaaccaccagggaggaggatatatagcctctgctcttcaaatcttcaggtacttccttggatttctaattcatggctactttaaataccatcctatctctcacacccccaactcctgttgatctagccactcaatcttgcaggtcttgtggccagattcttgagtttctccagcttcactttgaagtccagtttctatgcctgaaggcagagcagcctcagccttgcttgtagcatgactgccatgttcaagagtaaagacctcgtgtctctaaggaacaccatgaaaacacagttgtttcgtgtcagtttcgaaagcctccacagggctgcaagaatcatttgtgtagtagtggtggttgacgtactctctctcaaagaaagaacatcatgtttcttaggttgttttttagtgcgccttcatttcattctct

SEQ ID NO: 564 - protein, 3 aa, Zea mays
  misc_feature (1)..(3): Xaa can be any naturally occurring amino acid
XXX

SEQ ID NO: 565 - DNA, 6226 bp, Zea mays
aaaacaaagacccaacagtgcaacattgcaaaaataaattctcaaaggaattactcctggtcatctagagagcaagaggaaaatatgacaattcaatcccagactgtcttaatcagtggcagtcttaaccctatagctcattcggtttaccttctcaactattcaattaggattctcctgtacatacactacgctgtaatttaccattattaatacaaaatttacagtaggagtctctccctcctgatctttaaaaaaccacttgatcaccttctccttacgttcaaaggacaacactattacttcgtttggatgttggaatttggtagcaaggaatcgaatagatgttgaataccaaatcgctaaagatatttagcgctcccctatcgatgcaacgctgctcgcttgagcccctctatgctctacagtacaagggctatacacaggaatccgcgaaattcggcctgaggctatccgcagcggttcttcctaatttttccctctatatcacttttttgcgtcacatcatcaacatttcaccccctatttttttcatctcccgcagcggttccccctatattatcccctatacccaactaaaaatataaaatatcattatctaaccatatttatcttttattactatttttatcaattattaaataggggagcactgtgcaaggggcgctacagtgctccccttgatctgggggacgtgcgcgccctctccttacgctgcagcgcgtaggggctctttagtgtcagtcgctgcgggcctagagatcccgtacgtgagagacagaggaggggtcacggcgtcgcaagcgctgcggccagtctgagcaaaccaaccctttgtctgaaatgtcgtgcgcgcgcattatttgttagttaggtaaaataatattttatggctgaggtagggagcggaagaatttaggagaaaacccgttgcagaaaagagaaatgtaggagataaaatctgatgatgttgcgcgcggtgccgccacaagcccacaagcttgcgcagcctccctccgcccgtccctggcgtctacaaaaagccctcggcaggtggcgagtggagacgctccctcatacctaccagccaaaccaagcaagcagggaatccccacaaggcagcagatggaagcgaaaggtggcggtggcgcggcgtggcgcgggcgcgggcgcggctagctaggccggctcgtgtgcgtgcgcgaggagacagccacagccatacagggatgctgcctgcttcgtgaccgtgctggtggtggtgggctgcagcctgcagctcgtatcacacgcccacagtgcaggaaggagggagtggaagaagagagaggaagttgtttttaaaggcaacagcgagtcccgctgctgtccctctccttcgccacctccctccctcactctcttccctccctctcggaggaggagagagaagagagggagccagtccagctccagccagccggacgcccggaccaacaccaccccgcctccccctccccccgccccaccggcccgccctctcgcgctgccgtacccacggccccacgcacgttcacaagtctcgtcgccgccgcaatggagtccggcggtggcggggacgaccagctgcacggcctcaagttcggcaagaagatctacttcgaggacgccgccggctccagcagcggcagcagcagcggcggtggcagcgcgcccgcgcctccagcgacgcagcagccgtcgccgccggccgcttcgcctagggccccggccggcggcggcaggaggggcagggccgcggccggcggcgcgggcccctcgacggcgcccgcgcccgcgcgctgccaggtcgacggctgcaacgttgacctcaccgacgtcaagcccgcctactactgccgccacaaggtgtgcaaaatgcactccaaggagccccgcgtcctcgtcaacggcctcgagcagcgcttctgccagcagtgcagcaggtcaccacccagccccgccccgccattgctgcacagttgcactccccccctcttccacctccacctctcattcaattgattgtttccagttgtcacttgttggttgcattcgctctgcagtctgctcccccgtgtttttttttccagtcccactcccttcattcacagtctagggttttagggaggctacctagacgaagaccagacggtttcaggtccatcataccacggacacgctacaaaactatagatgcgctaaacagtgggagctagggaaagaaacttggctcggtttgacggagcttccatcccatttcatctatggcgacggcttctcctcctgaagctgaacaagaacgaaggaggaaaaaaacaaaagctgctttggcattactgctacgctttaatgtttcgcttgaatggtgctcatgagcacaggtaggtctgatggatgctcctcctaaaaatatgatagagtgatgtgactcagcctgcccctgccctgccctgcctgtctgtcagttcgctttgcattagattccaccgctaatactactcgggtatcccagtgaagcctgtcagctaacaagccattacaataagcgattagtagccttgagcctggttatacgtgtggtccccaaaaaaggaacagcaacagtgaggaattttcaaaggagtctttgctttgccgatgcagtagtattttaatttagaggagtcccaactttgcacaggttgacactatccattgttttagctagctagcctgcctcaaatatagcattatacattgtttgtcccctgtacttaaccatactacatcgggcatccttcgcccccgccccccccccccccccccccctttttttttttgcattatgcaaatggtcccccgaggaagaacaagttgtagcctttgcaatgtgttgttcttggcgctgcaactttacaggttgtacgatcctgttcatccggtgtaagatctggaggatttctagtcccttcaggtgctacaccaaactagactgttcctggaacagctttgtttcctttggatacaattagcattttcattcataaatcttaattcagtcatctatctaatttgacatacaatagagagagagagagaaactaaacatgatggtggcgagctgcatctaatttgatatgggtagggcctggacacattaccctagcggcgaccgcaggctttgtgctttaggactaggctacaggagtgtcctcatgtccccagcaaaagagaagggcgccacagttctggatttggggctctctactaaaccacactgccacttatagcaacaaggcatatcattagagaagagctaagttggaccagccaccagtaccacttggcgttattagatggaaacctcattattggtgggtgtgtactgttgtgttaagcccggcatcacacatctctatgaaatgattacacacacactttctctttgcttttcttttctttttagtatggatgtgcaggtgtcattatgagcggcataagacagaggttaatgttaatctttaatgggggatgtgcagtagtacaaccctaacctagggagaagagaaatgttactctctttgatgattgtactggcattcccactggctttgacctaaagtgtggtttcctatatccatgtcgcgctaagcgctatgcatgttgctagctactactgagataaactagtgccttcaacttgctacgtactgtcccaccattcagcttgcactttattctactgtaagagttactactatggtaaatggtttatgcttggtccatggaacttttttactgcctgatttgtttgcattctacacaaaagctatgaatctacagcaatgtatatgtggatttatagaatgcaacttccattacttataaaaattctgttgctgtgccaccaacttccattacctgtaataaactgggatcaagggcgcgtgaatgaacacacctctgtttgtcgcatcaatcgcaggttccaccagctgcctgaattcgaccagctaaagaagagctgccgcaaacgcctcgcaggccacaacgagcgccggaggaggccgccgcctggaccccttgcgtcacgatacggccgtcacgctgcgtcgctcggcggtaaccaaaagctggtttttaccctgtgatgtcgtctcggcgaccaaagttcccgtcttttttttgtaaccgctaatgttcatgtgcttggtccagaagagcccggcaggctcagaagcttcatgctggatttctcgtacccgagggtctcaagcgccatgaggggtgggtttccggcggtgaggcccggtggtgaaagggtgcctggcggtatccagtggcaagcgggcttggatcctcgtcaccaccaaggcgcggtcgcgggatacggcgcccactatgggagcgagggtggtagctcgtcgtcggcgaggccgccggtgttccctggcccggagctgcccccaggtggatgccttgcaggagtccccgcggactccagctgtgctctctctcttctgtcaactcagccatgggatgctgcccacagccacagccacagccacgctgcgccaacagcgggtttcgacggcggcagccctgtggcgccctccctcatggcggcgagtagctacatcgcgccgagcccctggaccgagaccgactcctggggccacgaaggcgggcggagcgtgcctcagctgccacctgacgacgtccccctcggcgaggtgcactccggctcgagcagccaccacggccagttctcaggtgagctcgagctcgccctgcagggaaacaggccagcgccagggtcggcggcaccgccagcgccgcgcaataatcagggctccgcgggcacgttcgaccaggctggcaacacgatggactggtcgctctaggccgggggccgaaataaagcgcagcagatcctagccgcgcagggagatggaggaggctgaaagtctgatgctgcacgctgcttgcttagcttagagcatccagcatgataagagtgatgaactgatgcggtgtcaggagactagtttattctgtgcttcaccatgaactcgtctgtcgcggcgtctatgtagacagacggcacacgtccgtggttcgaagttaccagtatgcttgtcggggactttgctcgcgatgcattaatctcattgttcaccatccagaaatctcatgttctctactcgtttgctggcccgtccatgctgccgctgctgtggtctttacatcaccatggctccgcctccatgcatcatcatttctactgaataataatgtgcttgtaccctccaacgttgccgcctggcattgccaagaatcggttccaagggggtgttgtttaagtaaagcgagaccacaggcacagcgcggctttgcagcatgctcttggcaccagtggtgtggtgtggtgttgctgctgatagactgaccgacggcagaatgagatccacgcagcagcttctttcaaatccacaaaattttctcagtggagaacaccagcacctttcctgcgaaagattttttccccttcccttgcgaattcatttcccttttgcccaaccacacagtctgctgcgcaggtgtttcaatttccttcgctcttttgtccagtctccactgttggttgagcagccggcgttctcgatttcttcactgttctggatctgttgtacaggtcgggactgtagctgccgctgcgctgcgtgattgatggtcggaacagttctgaggaacccacgctcgaaagaaaaccaatagaactgcatcgaccgcaaatgctgtcgtctttcgccatatgcagctcctgcgacgatgaacagtgatcgttccaggcttaccatcggtgctcagtgatccttagacgacacacagtgcagggattctatcgtcacactgtagatgctcgagagagagtagggttgggcattcacgagtcacgactacaagctcgagcagattgtcagtgttaaaagacagatttcaatatggtcgcagattctttgtcaatatatatatatatatatatatatatatatatatatatatatatatatatatatatatatatatatatatattgttggggccttcgtcctccgaaggtcctcaaaaacatgatttgacaatgttttccaagtggattatgtgaacaggtaccttcggactcagaattacgaacatgaag

SEQ ID NO: 566 - protein, 403 aa, Zea mays
MESGGGGDDQLHGLKFGKKIYFEDAAGSSSGSSSGGGSAPAPPATQQPSPPAASPRAPAGGGRRGRAAAGGAGPSTAPAPARCQVDGCNVDLTDVKPAYYCRHKVCKMHSKEPRVLVNGLEQRFCQQCSRFHQLPEFDQLKKSCRKRLAGHNERRRRPPPGPLASRYGRHAASLGEEPGRLRSFMLDFSYPRVSSAMRGGFPAVRPGGERVPGGIQWQAGLDPRHHQGAVAGYGAHYGSEGGSSSSARPPVFPGPELPPGGCLAGVPADSSCALSLLSTQPWDAAHSHSHSHAAPTAGFDGGSPVAPSLMAASSYIAPSPWTETDSWGHEGGRSVPQLPPDDVPLGEVHSGSSSHHGQFSGELELALQGNRPAPGSAAPPAPRNNQGSAGTFDQAGNTMDWSL

SEQ ID NO: 567 - DNA, 2746 bp, Zea mays
tacccagattcttctacatcgccatagaggatgtagaggacctcgagcaggccatctagctggcctccgactcgccagtcgtcgcggcggcggcgtagatatatttttctcccccacgtctcctctaacaaccagataagtcttgtatattgtatgtcgtgactctccaccgccatacaatacgtggctgaacagccaagggagagaaagaggaggcacctatgacgttctcctcctttattttgcggtcctttattaatcccaacttttctatttcttttcttgttttcccctttcccacctagattcatccttgcagtgtagatctatttttcttccacacgtctagcctaacaactagataagataaaacttatatcttatactctctgttccaaattaaaatttgttttagtgaattattggattcaaacaattcttgatattttgtatatgtgtctagatttatcatcatttatttgaatatatagataaaaaacaatagttaaaacgaatattattttaagacggagcgagtatatcatcatacgatacgtggctgatctcacaatctcaacgtggtcaaagttgtgtgtgccgggccatctgcgcgtcgtgtgacaccggtgcatgcgcagccttttgttttgccgccccgcccgctccatgcatggcatgggtgcaggttctgtagctatgcccggaagcacctagctagctcgcagcctacatctgcaaactcacaaagtttgggtatcggaggcatcagcaggtcgggttcaatggaacgacggatcacgtctgtgtgtcgctttcgcagcagcggggagagcgcggggcccggcccaggacgcatggaccgatggacgcatgcagaccatttttgtttttgtttttgtttttgtttttttcctgtctaaaatgtaggtgtgctctatcttgcctcttcatgcgataatgtgtgtgtatatatatacatgcccttcactcttcttatagctcgctagcccagctttagtttatagcactctctcactcagtagtcagctccctccatttgtccattctccaaaggtagttagctaggttaggcacacgcgcgccactcgactagctagcagctatggagggagaagatgacggcgcccaaatgaaactgcagcaacaacaacagtcgccttgcagtgacaacttgagcttgtccgccgcctcctcatggctgccgccacaggtaaggtcgtcgtcgtcgtcgtcgtcgtacacctgcgggtattgcaagaaggagttcagatcagcacaagggctgggaggccacatgaacatccacaggctggacagggccagactgatccaccaacagtacacttcacaccgtattgctgctccccatccaaaccctaatcctagttgcacatcagttcttgaccttgagctcagcttgtcgtcgctgctagcgcatggtgctgccagcagcgacggaggcttgtctgttccagtggcaaagctggcgggcaaccgtttctcctccgcatcgctccccacgaccaaggacgtcgaggggaagaacttagagttgaggataggagcgtgcagtcatggcgatggcgcggaagagcgtctggatcttcagcttagactgggctactactgagccagacagaggaacgaactgctacaatgggtacgtgcagtgcatgatgatggaatgactggctttgtataataataatgatgatccgattattgttatttctgtatgctaaatatatgtctcttatgttagatttaatatatatgacatattttatctaactaaattaaataaattatatataggcgtcaacgtattaaatacgtctagggcatcgtagtctttccgaggtgtcttaacgtaggaggctttggggccatcggaccctccgggctccggagctttcaacgcctcaacggcgtcgagatcgaccctctcactactgaagacggcagacaaaacaaaatatactcggcaaaatatttgtagagtgccacactgagcaagagtactcaatgaatcaaatgtcggcacatagacaagctgaccgaagttaaatgaccgacaaagatttttcggtttctattctgtgaagtcctaggctggcatgttgtcatatattgaagctaggagcaaagtttagcactgcacgcagacatggttgtcaatgttgtgggtgcaccttgtagtatttaatactccctcaaggtgcaaattataagtcgtttaggaaaacgacaggtactccaaaatatagctttgaccaatatttttttttaaatacaaatgaactcttaatacatttatactttcgtaaaagtactttttaggataaatcgacacatatgactattaggtttcaaagctaaataacaaaacgattatttgtagtcaatattttacaagtttcatttaatccttgtccagaacaacttataagttggacaagctaggccttgcaaatccgatggttgtggaaagaaaaaatgatgttatgaggccttggaaaggattggaaattcctatccttcccaacgcccttgcaatggcaataacacgttgttttagtcagataaatggatcagaggttacagagtatcagatttagctccttctcttatgactgtagttctgaaaaagattaagggctagttttggaaccccattttcccacgggatttttatttttccaagggaaattagtttattttcctt

SEQ ID NO: 568 - protein, 175 aa, Zea mays
MEGEDDGAQMKLQQQQQSPCSDNLSLSAASSWLPPQVRSSSSSSSYTCGYCKKEFRSAQGLGGHMNIHRLDRARLIHQQYTSHRIAAPHPNPNPSCTSVLDLELSLSSLLAHGAASSDGGLSVPVAKLAGNRFSSASLPTTKDVEGKNLELRIGACSHGDGAEERLDLQLRLGYY

SEQ ID NO: 569 - DNA, 3704 bp, Zea mays
ataaaaaacggacatacacacggatatatatatatatatatatatatatatatatatatatatatatatatatatatatatatatatatatatatatatatatatatatatatatatatatagagagagagagagagagagagagagagagaggatgcatgcttgtaaagaacggaagagatatagtagcagggcaagaaaggggcacggtggtggtggccgtgctagctgggggcgcattcaagcaagggcatgtagtacgtacgtacttgttggttgcacacattgatgggagtttgtttagtttccttttcctcgcagggaaagggaaagggaagctggctggcctgcaacggctgcaactgcaaaggtggttgcttgcattgctcatcctgctccgtcctcacgatcgatcggcatgcatgcatggcccatgcatgggaatgggaacggcaactgcaaccgcaagcacacatctgcatctgcatgcatgcctagcttcctttccttctgggctagctaagttaagctagctcctgcaaccgcaagcgacgacggcgatggctaaccgctagctaggtctcgatcgatcacaccacctcgctctacaactacgacgttcgttacacttgagacgccgcagcagtacgcgcgctagccgccggtgctggtgatgtgtgtttcgttgtctggtacgttatctaatataaaacctgaagaatcaaaattatttaataataatattgactgatgaagcattcatggatatatgcatgcatgcagtaaaaaacaaagaaagctgctgggtagccggccccacaagtaagtacgtagcacgtactcgtgtcaagtttgcgcagctgatgcctgatgagggcaccacacctaagctagctgctagctagcttcttccttagctgcgtacctttctgactctcaggctttgtgtactgatcttatatttataaatatatatgcgccaagggcaagcgaccccagtagtcgtcctcctcctcgctcccagcccagctagctagctgctgcatatgccttctagctagctagctttcatccccggccccctttcgatccatccatcctgtgttccaagttcatcattcactcgtcactaatagctttctatctgatcgattcatcatcatccgggcatgcatgagcatcatcgtctccagatcgttgggctctcgcagctacctacattcaacattcaagctcgctctacatatgcatgcaaatctgcaacactcgctcttggcagggatacattcacgccgagagagagagagagagagagagagagagagagagagagagagatgtgtgtgctgtagtcatcagccagccggtgatttctggagtggcatcatcaagattcacacactgcatgccaacataatgcgcgtgttcatgcatccatcgccgccgctgcatcatgcatcatatataatatatatatatgtgtatgtgtgggaatcttgatgatgctgcattggatatcaagggctatatatatatatggatcaagcatatatatatatatatcagatcaccagtcatatcgagttcttccttccaggcttgctaggtaatttataacttaaaccttgttgctgaactaactaattttacttagctagctagctactactatacttcattgttagtagtagctagcaagaaggaaagtaggcatcccggccggttcgtaccttctttttttttgcacagcaggatctgaccttctgtataaaatgcatttttgccttgagtttttttgtttttccacagtaggaggtagctgattctgatctgctgtataaaaatgcatttttttccttttcatttcatggcagaaggcaatatataataagaaaagactgaaaggaaaaggcaccactgccatgatggatcgcatcagtgcatctgttttgttcttctaaacgattcaggtcatcaggtgagctaggttggctaataagtatatagattaatttctattttgcacatgatttatatggttttgactaaatagttatttagcttaccaagatgtcgccaccatgctcagctcagctcagcacagcaggatttgtatcgctcgtatgtgtggctgggctgccagagcgtgttcggcccaatctaaatccggattggcatagcaggccaaactgggccagccatggatgaccccgacccataattgtatgtttgggcctggtttggatcatcggtcaaactgacccagcgggctgcttgcttcaactccgatctccactctcctctcctctcctctcctctatacagagattagagagaagagatctaggaaggcagacactgcaactagctagcaggtccggcaggccgcacgccatggacgcctccgccggcagcgtgctctgcagcaggagctactcggccagcgtgagcagagcctcgtcttcccagcaagcagaatcgtcgtcgcggctgtgcgtggaggagcaccgggcggaatggtgattcatctgcatgtactacgagcagcatttgttcgatttttccgctgtgttcgtaccgagaatatccagtcacttgtgggtccgagagagcatttcgtttgtgagttttagtgtttacaaggattaagtgaaaacttcacaagtaagtcgtaactattttctgcaaataagttttattgtcttacattcaccctcctctagacgtatgtttcggtccttcatcgtcgcctccgtcatgttgtgatggtcctaaaagcacatatatattgtatctactaggtgtgtgaccgtgcgttgccacagaagttaaaaattagtatacaaatctagatacagaacaatatacaaaatctttgtgataaaatatcactgtaacactaatattatattgacgatataaatatataatattattataaatataccgactcaaatagaatgaactgacgtcgaacaaacattataatcaagaaaatcttattgatctcggtcaaaatactgaaccaagtagtagcaagaggctaagaacttaggaaaatgattttctaaggaatcttcagactcctaggtagcttcttcttctgtgtgtgttggttccattgtactttgtaaaacttgagagtcctttttcgagtaactcggtctttctaatccaaaacttggatgggatattccgaataggttaagtctggttccaaattaacatcagacacatccatagtttgatcagggatccgaagacacttcttcaattgggatacgtggaacacattatgtacagcagacagtgattctagcaactgaagtatgtacgcaacctgcccacatcgttcaagaatagggaacgggccaatgtatcggggtgctaactttcctttaaccccgaatcgactaataccctttatcggtgatactttcaagtacacatgaggttggacggacggtctcttatgcattgactgtaaagtatgcctacgcgaaggccgctgattgtatagtggatggcaattttgtcatcaatcagggcagttgcgacttcaggaggaggaactttttataatagtcatgaaggctttccttttcttgttgtatgcagagggacaattctgccaatgtggttgtttcaggtctatagccttggaagttgagtaggaacttatgtaaagggtcttccaagaatcc

SEQ ID NO: 570 - protein, 3 aa, Zea mays
  misc_feature (1)..(3): Xaa can be any naturally occurring amino acid
XXX

SEQ ID NO: 571 - DNA, 7041 bp, Zea mays
tactcgaagaaagcaccaatgctgaaaacaacagctgaaccaaaagttagacctctgatacaaactgaagacaggtcactatccaggtttctattgatgctttctctttggccacatcccaggtacaatatatattccattaattcagcaccatagtcaaagatgaaatattacgaatgtatatgcatgctaaaatggcctgtttgcagggctgtggacctacccacttacatccttgggtacggtaaatgccatggcatctttgtatcagaggccatgtttagcacaactatacatccaagaaccatgtcgaatttaaggtttgcaggataaaatatgaggtgtgtacttattttagaaacgatgggtatgttttaatccaaactaataaataaaactgaactggaataatacgtacgtacaacatacgcacaacttggtccaagaatctgtacgaattagggacgagcagttccaaaaaaaaaatcttggagctttttagttgtgccacaaacagtcccctatgcctatgtatacatccacactaaattaaaggacgtcgagtcgtcagattgatcgatcgatcgccctttattggagtgatctcggtggagatgacacatatctgttcatcaatcacacacaggcactagtacccggcctaccacagcgaggtagcagctgcagtggtggatcgatgtgaggcgcgtgattggatggacgcgccaatccaaccatgcactatgcatgcgcgccccgagatgttatgagcaggcgtacacttgcatgagcgagcgggagatggccgatcactgtgcaggggttaggccggccgtgtgtgcgtcttgcttgtctcgaatagatttatggtgcggtgcagctagccagctctccgcccgatcgctgcgtggttggtctcgtgcgtacggacccatgtgtgcggggggcccagacattattgcaggaatagaaaccctacccctatcttctcttgcaacccaactctctctctctctctctctatctgtctgcccgtggcgtgctccactgattcttcttcttcttctacctcccggcctcctcccccttcttctttgcctgccttattagtatctcgcctcacaccacacagctagcagacagccagacacgcgctgctttctgatctctccccggatcggaggctcctcccaacataccaccctgccagccgcgccgccacgtccacgccggccggccaccaagcaagcatggatatggtttcgcagtccgagcacctgtgctacgtccgctgcacctactgcaacaccgtgctcgcggtaaactcctcgagaaatcggatccgaataatgaaacatcagtcatgcatggcgaagatcatgagatacggctagcaccagatatggcatttcttctgctcgttatttctttgctaaactcagacaagttttcttccccggttcccatttttcttttcatttgctttcttttctttcatgtacatgtatatatccttgccttgtacgcatggcgatagccagtgctgctactagctcattattcacatggcaaccaattaaatccagtctttctctttcttgccttgagattggatgagaacgcatatatacatccactagaattgacaccactgttgtgtcacacatgctttccgttggctttctgttgattctttgtggaatattccgcttgatagtgccgtgttccgtctttcacttctatatgtttggtgcttcgcaagcatccatatcttctcttttttgttgttgcatgtatactgaagttcaaactggacaagagttttctgtttactctctgctgctttctccacctatgctagctcatccctcagtttctttcctcctttagattttttattttcttttccagttgctaatgcttcgatcgacagtgccatgcaaaggaatggagttgatcttgtaacaggccgttgatctgattgcatgctgtgattgattgattttgtgcttcttgggtagctgcaggttggggttccatgcaagaggctgatggacacggtgactgtcaagtgcggccactgcaacaacctctcctacctcagtccacggccccccatggtgcagccgctctcgccgactgatcaccctttggggccattccaggtatggatcgatacagctcgttctctttggttactcgaacatatcttctgatcttcagcaagccgtgttcatcttctttgaatatgctagcattttttggggaatggaaattaaataaatatagacgaagtgaaaaaaattgaatggggttttctcatgaaatatggccatggtttggctttacttccagctgcatccgcttactgctactttgctctcactcctttctctctctttctttctctctgctttattgaactactcaaagtactgtttgcaaggcaagattaaacaacgctggactacaaaagatttctctttgctcatctctgcgcgttggcctggcaaaaggcagtgttgagcttttttaaggcggcggtcgcagcagtagcagcagctgctctgctgtggtattcatgaatgcatgcttctcctcaattcaaacacattttcttttggaaatagagatctatatccacgaccagatttgatggcctagtaaatggtaactagctaggaaatgcatgcttccatcacgcatcatgatgcatcgctaacgttgtgagagattttgaagcgctgggatctatctttgattgctatgctgccatttctcagtgtcagggaccctgcaacgactgcaggaggaaccaaccgctgccgctggcttcgccgtcatcaactgagctaagcccgagaatgcccttcgtagtcaagcgtaagtagcagctgaaagaagcacaccatccacttccttgttccttgctctctttttttctgttcttaagggatttatttttactttcttctcaaactctatgctcctgttagtgatgtgtgattgaagataaacagcagttaagtttgttcttgtactcaatgcatttgttttctttcattgcagccccggagaagaaacaccgcctcccatctgcttataatcgcttcatgaggtgaagaaacatctttttctttattttttaaaaatttccaaatacatttttttggataattgtttttttaaatacatatggtctcaaatagttacatgtgatctcaccttgcttggagtcaagttcgcagccctctctatatttacaaatctgattttgtaatgtcttctcaaactttgaactaagttcgacaaaatgttgaactaagatggatttgcatccaccgtatatggatactctctgctagctccttagtccttacacactttctccaactcgatgaagtaaccatctagtaacaagctaggcttgtaaatccgtacaatataagcctgagtatttacacagtagcagaagataatgcttaaaaatgtgagacgaacttgctgtgtagatatatatcgaggtctggatccgtcggtcagcagtttacaaattctactcaagtagttggactgtaggagctctgagtgcagtaataacaactagaccgcgtgcaaagttcacacattgtttttgctatctatatatatccgatgcatcattattaggtcagcactaaatctcccttctaaaaaaaactggaacatttaacaaagatcttaattcattagaaaaagggttcactctgggttttattattttgcatcaaaccatgtcattgtttttattgagatgcataagtaattactcgtgtgtcgtagtaaatctatcaattacattgctatttattttcgagatattagtctatagccatgtactcttatccaacattttccaagattttgggatttactccgtaaaaagaaaattgtgtgtgtggatagtgattccatactgcttactagatgtacagatgtatttaaacagaatttttgaaaaatcatttatactcatgccatgcaagcagcaaaagtacatgaatgggatggaagatactaaggccacgtttggttccattagtcatatgactaaagtttaatccatagactaatttttagtccctaccctgtttggttgtagggactaaacatattctaaacacattaaatacaacacataaagaccaaaatgcccctttttttgtttgacaccagttttattggaagagtaattggagtaaatgttgcactttagtcccttttagcacccatgtgagggactagagactaaagccaattagtccctattttagtccgtctatttggtaaaatagagactaaacaggactaaaaaaacagagactaaagattagtctctctaaccaaacagggcctaatttccctcgagtctggaaggaattaataatttaaaacaacaaaagcacactatgtaaccttcatttcatcttttagttttttttaatttacaaaaggatgaaatgaaggtgatacgccggcaatctttttattgtaaacattcatttttggtcttgaatttctatattttcccttcaaagaatctacaaatagtagttttgattattttagcaaacggaaacagtgaaaatacttctgacaaacacaataacatatatagtaaataagaaccgtcctacacatatgatacactcatgatgacaaccattttgaaaagaatggacttgaggacacatttcagctcgatcagttcctatacactccattgctgaaaatgtatctttgcttgtatttttttgatttcacctctttatacaagttgctcaacatgcaattattttctgatttaataaatgtatcgacacaattattaactttctaatttgatggcccctgcattaatgtttcaatttgctattaggcgcgcacacacgttagcttttacctttcactaaccaattagcctaagaatttgtactgtgtgtagcagtgtacaacttttgtactgttggactcgtatttgataatgcttttggtattatttgctggtcaggagccacgcaatttgagagggactaacggccagtgtgtggccttagaaattgcatgggttaaaccaccctacattttgaagcgccaagtcatttttaaagtgaaactattacattattgtgcattcaaggattacacaaaataaaatatatgtacaataaattgttttgtgtgtttcttagtggtcctacatatatagcattttatgaccatatgtcacttctataaagaaaaaaaataagacaagcttaatattaattctttgactagctatatattaccgtttttacattacatgcatgtggcagggaggagattcagcgcatcaaagctgcgaagccagatatccctcacagggaggccttcagcatggctgccaagaatgtaagattcctggtcaatcataaccaattcttgaaagcattttgacctattttctctctaatgccgtgctgcatatgcagtgggcaaagtgtgacccgcgctgctcgacggctgcctctaccgaaacttctaacagcgctcctgctgagcctagagttgtgcccactccccagttaactgagccacgctttgacctggaggtactgcaaagccttctcccttcactcttctctgtagacaaataagcaagatttgaatatgctatgctatttcctatacgcacatgcatgcatgctgctcttgcaggatagggccaaggggcaagtcattgagagcttcgacatcttcaagcatattgagcgcagcatctagaggtcgttcgatgccgctgttgtagcccagtatcgatcgagtaccatcagctatatgtataacctatcccgtatcgccgtcgtcgcctcgcaatcatgcatccccatcctgtacttttacccccgtacgtgttactgttgctgttattctcgttatggttggattgtacgcaccatttaattatgaacagctgctacctatatatataatatttgccttcttttttgttcctaatatatgcatgtttacgaattattatccacctctagtatatatatgtagcgtgtgcattaatttgcattattatatcgtgtcgtttacttactgtaaccaataatgtagtatattcagagataaaattaaagttcgacttgttttgggtcagctgggtctcgactcaaatggcaatgccatgtctatttcatttagcatctagataaatgaactaataagatggcatgccatataacttagtagctgacccatgaaaaatagttatcaacccctactagcagtattacattgtttctatatatggtcggagggaataggccatagaagtggtcgttcaatatatgtagaagtgggtcttctttagatcacatgtgtagcaggctccaagatattaagggggtgtttggtttaaggaatcactacatctaaattgaggtggtgcatcatgggttcattactcaaatttggtggaatgacctcattcctaatattagtactaactaactaactatgatgaatgagttggtgatggatcaactcattccattccacaaaccaaacaaaaatagtgaggagtgagaagataatggactagctcattcctcaaaccaaacaccctataactttcttgttttctatattgcatgatctctccagtaaacaaacaggaggagattatttttgtcatgttaaacatattattactatttatattagttgtttagctaactacacaaaaatgatgatgtgatgattactaaaaaatgatgattctatactgtttttacgctttaaatttagctaaatggttcgtcaagccaaaatttggctactcaacaacaaaataactctccaacatactagtcatctaactcgccaagctatccgactctcaaaatgagctccctcactagccaaacttagctagccactctgactagccaaactagataaatagtcttccaaaaacatgatatgtatgtttagataaccatgacaaat

SEQ ID NO: 572 - protein, 205 aa, Zea mays
MDMVSQSEHLCYVRCTYCNTVLAVGVPCKRLMDTVTVKCGHCNNLSYLSPRPPMVQPLSPTDHPLGPFQCQGPCNDCRRNQPLPLASPSSTELSPRMPFVVKPPEKKHRLPSAYNRFMREEIQRIKAAKPDIPHREAFSMAAKNWAKCDPRCSTAASTETSNSAPAEPRVVPTPQLTEPRFDLEDRAKGQVIESFDIFKHIERSI

SEQ ID NO: 573 - DNA, 9930 bp, Zea mays
cgtgaaacctcgagggtcggctctgataccacttgtaacactgcgtccaatccctggaccggcggtacttactcctaacagctctctaggatcatatattgtccctacagaccaacacgagtcttttgtgcgtactttgtcctcactcgtgcgcatccgagaaaactttccggtcggtcaccatccaaaattgctccaagtcaaacacgcttaacttggaggttttttcgagacagacttctgaaaaaagaagatgcaccttgttggtatggatactttattaattttattaagccttgggccaggatatcaccatctcaggggccaggatatcacaaatttttatttcaataaaaatagtatgttgtgtggttttttagcgttgacataaatctacgtgaattacttaattctgaaatagaaaaccccgatgtggttgtgggtttagggtatagcctgttgcagactatgcacttgaacaataaggtcaagagtgcagtctggagctgacgtggtagagcaagaggggatggtgcactgacacccgcctaagcaaaagtttcctttcaatttgtagcaaaccaatatgttcaacgtgatccctatggtgtgtttggttgaagagttaactagaatgtgacagttttatttcaaagaatggagccattatgtcctatgtttggcaagcagaatatatgtgtttcattttttttgtctggttaaagagtaaaatattctttgtttggttagagatgcatatgattagggagggaacgagggggagagtcctcccgtccaaaagagcgctcctatccgattattttggtggaaaaaacattctaattatttatgatacatttttacctatagactttatgagccgttttatttctgttccattaaaaactaaacacccagaaaaaaaaacacctcctcgttccattctcgtccgtttctcgaccaaacacgctctctctcggcagcgatgcgagaacgtgcctttccttctcgctttcactggtaccaggtggcgaccatacagcacggaactccagttcaccgctgcctttcttctactgttcaccccgcgtgcgctcgctcactcgctctctcccctctggctctgagtggcgctagtgggcgaccgccgccgcgtccctccgtcaggtgcccaggtgtagcctcgtcagcccctccgtcaggtcttcgtcggccccctcgccgacgagcacccaccaggtacgcgcacccccctcttcttcgcttgcttccgtgcggaaccgagcacccgaaccctaacctaagctatttgcgtatttgtattcggatctgatctgatctaattgcaagcttataaatgtaccatgctctaacttcgtgtttttgcaaacattattgggcgtacatgtgtacacccatgtcctttactatatccgctccccagccaggcatgagagcgcgcttctagaataatgtctgtgcttacctgcgtgattgaaagcatgggctcatcctgtagcagatcccattctttcgacgaggctgaagcagctgaaaatgcaaaggtaacttgtcacttagaccaggctgatgctatcaggaggttatgattttgtgttggtaagcagcaacacttggttccttctgacattagcagtgtgggtgcagtctgcagacattgaccggaggattttgcaagaaacaaaagccgaacaacacatccacaagctcttacttctcggtaatgccaacttacttgaacttaagagcttttttttcttcttcatgtgaagtatatctgttctgtagttttctctcttgatagtttgctggatcagccaaaagaactgttgcgaagttgatccctagtcacttctctttccatgcattctagacttgataatgtgcctgtccattgataaggtactttgcctgtattcctaacagtcatcctccttttcaatcacttctttgtaaggtgctggagaatcggggaagtctacaatatttaaacaagtaaggtttatgccactccctagaggatcataattcttatgtcatcatcaagacagcaagtcacggatgtgtcttaccgctcattcgcagataaagcttcttttccaaactggctttgacgaggcagagcttaggagctacacatcagtcatccatgctaatgtgtatcagacaattaaagtatgctatactaaaaagggtgtgtctttttttttctatcacgttgtagagatgattatgtaggaaggtttcgttatggagtttcttgctgctccaatgagggtgtatttgcagatattttttctcagtaaatgagttaaacatgcacacgcagatattatatgagggagctaaagagttagcccaagtggaaccagattcttcaaaatatgtcttatctccagataatcaggtttgcacacttgccttcagaaattagagttaagttttggcaaacttggttattttgcaatgtaattgtcctggtgtggtcctgacacaattgctatggttgaacctgcctggagctgttataatccaaactgccttattatgctttgcacgattacatgctaacaaaatgagcatttgatcagagaaggcagctaggaaccttgcccctacattttattgcttcagagaaggcagctttagatttgctcaaatatttgttgtctcaaatgtttattatgcagtattcatctatgtcaagttatgagcatttgctttgtttgtagttatgaggttaaatagttaacaaatctcatcttggtagacgttgcaatgcgtttattagctcttagaagcttctcatagcacaccacacacatttttacttaattaccttttgtatatttgtattgtaactttattattaattcaggagattggagaaaaactatcagaaattggtgccagattggaatacccatcgttgaacaaagaacgtgtacaggatgtaagaaaactatggcaagatccagccattcaggtgaaattccatttactttgattttttttaaaaaatgtataaacttttaaacataaagtttgatcatttagaaattcatttgtaggaaacttattcacgtgggagtattctgcaagtcccagactgtgcacagtacttcatggaaaatttggacaaattatctgaagaagattatgtaccgacaaaggtacacaattatcctcaatctatttttaggagagattttacatatgcgttttacaatgtcacatatttcatgttgattgtcatggtactgaaatctaccttttgaggctatcagatagcagcagaacgagaacctagattaactatgaaatatttcttttgaagaccttaggagatcattagttaaattagagtatattatgcatgttagagtatattaggcaactcctgatatggttggtttaggattgattataatcctgggataaccttccttacatctgggataacctttcttatctctaggataggctttttgccctccaagtcatgtactcctatatattctccctagaggctcaatgcaatacatcccacacattatacacattctctccttccttcaaaatattcagtaaggaaacacatattataccttgcatataacaaggcagaatcgtcatgcccagttgcagtgcgtcaaggaaaaaaaactactaaactgcacagtgttattaaaactacgtttaaatgatgcttaaactacgtttaaacgtcaaaactctaattagaggttaaaaccacgttttagcgttttggcgttctaaactgtaaaacgcagtgttttatgcattttagaccattagctacttttgggcccagtctattagttacttttggggttcaatccagctcatgggtgaagttttggtaagccactaacctctctgttttggtatataacttcatattattgtctgaaattatgatgtattggtatctttcctatgttgtttaaaactacgtttaaaagtcaaaatttcacccatgaacgttctaacgttttatcgttttaataaccttgaaactgcaatatatcgggcttaattttatctgagtctctcaggcctcaagctcttgagtttccatgtggtcctctaccagaaacttttctttgctgaaaagacttccgattcctttgtcaacttccataacataagcttggtcacactagccaagttatttttcttcagcaatgatgttccctcctctcaagcaaataaaggtggtgttaaattatatttatgtatttgaataatagtagcacattaggaacagcctctaaagtgatagtatatgctgcggaggattcaaaaacacagcccccgcgtcgtcctccgctcgggcgacacgggtggcccctaaaccctagcgtcgccacccccttcccctccctccccctcgtcgtcgccggaggagtctacccgaagtcggcgcgggccccaaggatggcggtggcggggcgttcttccttcgattggtctccccgtgctcaaatctgaggtctgagtgggtttctgtgtcgggcggtttagtcgcggcgcagcagtaggcgggctcgcgtagtggcggcgtctaggcagtcaaggtccccgcgcgggtgtggcgctgtgcgtgcggcctcgtggcttggccacgttccggcgctccgcgatctcgaccactgtctctaggacggcagcggaaggatggcagagggaggtgctggcagcaggctgttctaggcgccagtggttctgtctctgtactggcagatccttcaggcggttttctcgccagtgctgccgctggggctcacggtgcggctggcagagaaggcagagtgtcgagccttcttcctcttcggtgccgaggacaagtcgctccacttcttccgggacctcgtcgtggctgggcatcacacgcttggtcctcaacagcggtcgcctcctgttgtgagacgattgaggagcgtagagcttgtctcctcgcactgccaggacgccggatcggggaagaagcgttgccaaccaacggcgtgcggagctcggaggctgagaggtgttggggcggtgatggctgcggtctggtcctacgatggtgctccgaggttgggtggctcgacagcgtccaagtgtgtgtcggtttggggcgacggtggactagcggggtggccccagcggcgcctgctgtggtgcgcgcgccaagatctgccatgtcgcggttgctgctgtcaagtcgggccgacggagggtgcagcaccaggtgctgttggaggcgagttgtgtggcactcgtgctcgatgtctgctggcttcggtggccgcgtctgccggtattggctccggcgtgcgtcggtgtgtcgcatgcgacatggtggtgctcggttccgtgtgcccaaccggagggggggtggccgacgcagctttgtggctgctgcgaagtcgacgcgtcgctgcccctctggaggggtttgtgtgggttgttagatcaacgatgacgacagaggttgcttgctttgatccggggtcttggcctgacgttgtgctgggggacttcttgggtgaaagtctcggcgacggtggcacccgcgggcttcgctttccctgttgagggctttgcattccccagcactatcttccttgggcgaaagcccggtccatctcggacatgcgacggtgcgtccgtgatgtcactccctccctgaaggcgtcgctgttgaagttttgtctcgaccatggtgttgcctttcggttgatgcttttgcttctcggcgttcggtatgcgggtgaaggtttggtgttgcagcgtgaagtcgaagctgctacgtcagtggatgtggctcgacaacgatgacgtgaggcgaaatcccccttcttcattgacaggattgcgtcgaaggttgggcatatgcctggggcagggcggaggatcaagattggaagtcaagttggtgaagaatcggagttgtatcacgtgaggtatcttgatgcttggcaacgacggcgcactgcggtcttccttcttctgtgtcggagtttgggtgtagacatcatcaggtttttctttggccttaggttgtccgtcttggggagtcgaagctgctcgttctttgtgttgagctcggcaacgatgactctggatgggctttgtgtgtggggctgctgctgtctaggttgcttgtgcaccctgtgtaggttttgggcccggttttccttaaaattgggccaattccactcttcctcttaattgagaggtagagctcctgccattacgttaaaaaaggaacaacctctaaagtaacatggaatcatctcgttcgtgatctgtcatgatactctttgtggatattttcctaaaggcatttcttgatcgatcatatatgctacttgtgtaatatttttttctcgaacgcgctagagaggtgcacatcattacattaagaagaaaaagggtccaaaatggaccagtacaagtacaagaaaaaacaaccaccttacggtggccaaaaacgaaaatacagaaaaacgtccatacaacaccaagagaactaccgctttatagcccaggaattggagctgttagaagagagaggctcttggcccctgccatatcccacaactccctctcttcctcagcccttctaatggcaacatttacattggagtgatcttgtcaaagacgcagccgttcctatggttccagatggtccagaaaccaagaattattaaggaattgagtcccttttctgctatgccttgcacctgttcgctcatccttctccaccattccatggccttcccttcccctggctgaggagcaagtccttgaagattgacctgtcccagcaatctgcaccaaaattcccttgcgaaaacacagccaactagtaggtggtcaattgattcaggatcttgatcacaaaatgggcattttgcaggatgttcaagccctcttttttgcagccggtctgctgtccagcatctctgaagggcagcaagccaaggaagaacttgcatttcggggggggggcacgatttccaaatcttatcactaggttcaaactgaattgatccaatgaaaaggttctcataagcagctttggctgagtataagctaattgtgtaatatcaatagggttttgctggtctgaacatcaaattctgtctgaattggaatccagtcatcctcatgccatatggaaatttaaacttatattttgttttaatttcctttcatgtgggtatttcatgatatctatttctgttactacctggttatttgaggaggtcggaaaaggcttgtacttgatttgtatatttgataatttatttgcgctacttgacaagggctgattttcaggaggatgtgcttcatgcaagagtacggacaaatggtgtggtagaaactcagtttaggtattccttggttatgctatttgcttattattagttagatataactctaataatcagtttttttccctgcagccctctaggagagagcaaaagaggcggagaggtctataggctgtacgatgtaggaggccagagaaacgagagaaggaaatggatccatcttttcgaaggtgttaatgctgtaatattctgtgctgccattagcgagtaagcccagtttccttgtttgcacttgattggcttgaacttaactgtaatgacaaattgtactcagaagctgtttttttccttcagattttgtttgggtgctgcaaaaattaattatagctgcctctaagtcactaaaactaattgattttccatgatcagaacatctgttctgttactgatgctatccagttctattctgagtgccttttataataattgtatttcaattgaaataaatttgtatttttgtatgtttggggcacttgacaggtatgatcagatgttatttgaggatgagacaaagaacagaatgatggagactaaagaactctttgattgggtgctaaagcaaagatgttttgaggtttgtatcataatcatcacaacgtctgttctcatactatctttttatcattaagagacctacctgatgcaattttgactttcagaaaacctcattcatgttatttcttaacaaatttgacatatttgagagaaaaatacaaaaggtaactagtgcgcttctttacctattgagagatgagtataatacactaattcacacatatgaataacactaattctccttatgtaggtccctttaagcgtgtgcgagtggtttaaagattaccagcccactgcacctggcaaacaggaggtggaacacgcctacgagtgagtgtgatcctgtcatcctgtgtctccctatggcttgtcagtatcatataaagatgcatatgcgcacatagatgccacattaagttttccactttgttgtcatctttacgtgctggttttgggtcttaaattcttaatattgaccaggggatcatttttttaggtttgtaaaaaagaagtttgaggagctctacttccaaagcagcaagcctgaccgtgtcgaccgagtgttcaagatctacagaacaacagccctggatcagaaacttgtaaagaagacattcaagctgatcgacgagagcatgaggcgttccagagaaggaacttgatcgaggatgtggtgttataagccacaagacaagtaactaggatggtgtgaggagcagaaagtttacagtgtcgcggctttggccgattgtgattctttttacatgaggaacatttgttgatctttttgccccaccacaagccagtaaaagtatctgttttgcgctggtcttggggaggtttgggtcgtctccatttccccccaatgttaggacaaaatgtacttaccatcttttggagctctgcctgtttggcctcacaatatcaagttcattcgttgttgtctatgcagcatgcctattcacgaattgtctgaatttgttaaccaacaacagatgaaagttcgattggtactctctcaagactgaatttggctacgcatcgcgatcacactatcggaattcaagaaagctgaccgaaagtgctacacatacatgcagcagaaagcacagccctcaccgccaaagcattacaaagcacaaaaaccatttgaagaaagctccgcaacgccaacgcattacaacgcacaaaaaccatttgaagctctgaagcaacgtggtgaaccaaaggggcgaactctgcatgcggcattgacagagtttgcattcgatggctagagagcgaggagcatgcatgtccaacacattgctgtgcagatctcgagcgtctgatgcgaagcatgatccccagctggtaacaataaggcatttgacgaacccagccacaagctcacatgcctagtgaccaccatcttctccctgtgatgtctttgatcgcattctccgcatccatttcctctggttgggactgggagtcgccgagctggatgaagcagcagtcctctggtggtgctgcgccgctgccgagctcgggagctccgccggaagcgcggccgccgtgctggtgaaggcgttgaggacgaggaaagcgaggatcggcgacaggtccagcgttcccccgagcggcgggatgatgccccggaagatgttcaggtacgggtcacatatcgtgctgcattgcattgccatcgtttgaactttttgacgaaagaagtgtcacactgtcatatgctagtttcggaaatgtaggttgtgaaatcatctcgttttctagcgacccagctggagctctccactctaaatctcagttcttgaactacatcaatagggaagcgtagcatgtactacctaccagagctgcgatggcgcctacctgagaggcgcgacgatggcgggcggcgtgttggggaaccacgtgagcacgagcctgacgacgagcaccgtgt

SEQ ID NO: 574 - protein, 390 aa, Zea mays
MSVLTCVIESMGSSCSRSHSFDEAEAAENAKSADIDRRILQETKAEQHIHKLLLLGAGESGKSTIFKQIKLLFQTGFDEAELRSYTSVIHANVYQTIKILYEGAKELAQVEPDSSKYVLSPDNQEIGEKLSEIGARLEYPSLNKERVQDVRKLWQDPAIQETYSRGSILQVPDCAQYFMENLDKLSEEDYVPTKEDVLHARVRTNGVVETQFSPLGESKRGGEVYRLYDVGGQRNERRKWIHLFEGVNAVIFCAAISEYDQMLFEDETKNRMMETKELFDWVLKQRCFEKTSFMLFLNKFDIFERKIQKVPLSVCEWFKDYQPTAPGKQEVEHAYEFVKKKFEELYFQSSKPDRVDRVFKIYRTTALDQKLVKKTFKLIDESMRRSREGT

SEQ ID NO: 575 - DNA, 9226 bp, Zea mays
tggctggggtttcctgtactaatggaagccctggactttcattaactcctctctctctctctctctctctctctatatatatatatatatatatatatatatatatatatatatatatatatatatatatatatatatatatatatatatatatatatatatatatatatatatatatatatgtgtgtggtgcctttctttcaaaacatattatgcaacgcgtaccgtatctcaacaaacaccttcaataagttgagtcggggtagatctcaaggctacataaaatagttttttttctagaatggatgcatttgttttaagagaaaaatgatgcacttggaatgcatcaagcaaagggatgtaagaatgttggaaaaacacatgaacccgtatcgcgagatgcttatttatccattctttatcacagtggatgcatatgcaacaaaaccaaaacagatggttagcgagtgacagtatatagagatctaaagttgtccgacacttcatcggtaaaaaaagcagcataaccgagtgaatggaagaaaaacgaatttctcatatacacagcaggttttcttaaaaaacgttatatcggtattatattaagaagagaccaaaatatggtcctgtcgagaaaatttctaaacattagttctcatcaccagtgagccgtcaccatctagtttgcaacggtccagttagagtgcactcaggactcgcagcgagagaatttttttaatcaagcctaaaattcactttcggacaaatcgaactactcataaatattaaccatgagaccttttcgccgcagcaggttttctatcggccgttagattttagtgacgatgaaaatgatagaacgcaacgtgccgcatgcatccattcccattcgttttccacagtacatgtaggagtactgtgcaagtagggtccgtacattcagtctctctcactagttggactcttctactgctacaaagacatgagctgccgggaatgggaaccggaggagcgagcgagcctgacggtctcacacacacagtcacactcccaagccaattattataagaggcgagatgagcaactccagctcttaaccaatccactcctcctccctctccacctcctctgctttgctctgccactctgctgaggtggggggcagaggagctccccctccctcctctcccctcctcgccatgtctagcagcgacccggaggagatcagggcgcgcgtcgtcgttctcggttcgccccatgccgacggcggcgacgagtgggcccggcccgagctcgaggccttccatctgccgtctcccgcccaccagcctcctggcttcctagccgggcaaccggaagcagcagagcaacccacgctccctgctcctgctggccgcagcagcagcagcagcaacacgcctactacatctgccggtggcggcgctgctcctcctcctccttcttcgcctccccctccgccggcttctctggagaccgagcagccgcccaatgccaggccagcctccgccggcgccaatgacagcaagaagcccaccccgcccgccgccctgcgcgacctcttccgcttcgccgacggcctcgactgcgcgctcatgctcatcggcaccctcggcgcgctcgtccacggctgctcgctccccgtcttcctccgcttcttcgccgacctcgtcgactccttcggctcccacgccgacgacccggacaccatggtccgcctcgtcgtcaagtacgccttctacttcctcgtcgtcggagcggcaatctgggcatcctcgtgggcaggtacgctatccctcctcctcctgccgccccagcttgtgtgcgtcgcgaattggcggtcaatttggattggatgacaaatcacgtcggtcagccaatcgccgtggctacaaacgagatgttcaaatcgttcgccccgctcgcagagatctcttgctggatgtggaccggcgagcggcagtcgacgcggatgcggatccggtacctggacgcggcgctgcggcaggacgtgtccttcttcgacaccgacgtgcgggcctcggacgtgatctacgccatcaacgcggacgccgtggtggtgcaggacgccatcagcgagaagctgggcaacctcatccactacatggccaccttcgtggccggcttcgtcgtggggttcacggccgcgtggcagctggcgctggtcacgctggccgtggtgccgctcatcgccgtcatcggcgggctgagcgccgccgcgctcgccaagctctcgtcccgcagccaggacgcgctctcgggcgccagcggcatcgcggagcaggcgctcgcgcagatacggatcgtgcaggcgttcgttggcgaggagcgcgagatgcgggcctactcggcggcgctggccgtggcgcagaggatcggctaccgcagcggcttcgccaaggggctcggcctcggcggcacctacttcaccgtcttctgctgctacgggctcctgctctggtacggcggccacctcgtgcgcgcccagcacaccaacggcgggctcgccatcgccaccatgttctccgtcatgatcggcggactgtaaggcccaccacaccacgcactctctccttctgctgctcctcggcccgcccccgtcgtcattgctgctgacggtatctgtggatcgcgtgcagggccctcgggcagtcggcgccgagcatggccgcgttcgccaaggcgcgtgtggcggctgccaagatcttccgcatcatcgaccacaggccgggcatctcctcgcgcgacggcgcggagccagagtcggtgacggggcgggtggagatgcggggcgtggacttcgcgtacccgtcgcggccggacgtccccatcctgcgcggcttctcgctgagcgtgcccgccgggaagaccatcgcgctggtgggcagctccggctccgggaagagcacggtggtgtcgctcatcgagagattctacgaccccagcgcaggtatacctagtactgttactacttttagcgcattaatctgaggatgtccagttcgcttgcttgccaatcgccattgccatcgcaacaacaatacttcgccaactgccattgctgggtagactagtacagtagcagttagaagaagcctccactgtacattgcattgccaaacaaaagtgaattgtgcagtaactctgtaccaccacattgacatggaaatgaagtgaatgcttggagcatgcagagctggccggcctcatgggctgctgctacctgctagctagccaaccagaaccagccatcctctttcttgcttttctttttactttctttggtcgtggctgtttgtggtcatacatacattcacgcagagcagaagagctagctaagctaggtgggtgtgcctgcaacgcgggacaaagaaaactatttgttgcctggcaagatgctactgttgcctagcacatgcctgccattgaccgactgctcagtgagaagtggttcagttgtgctgttgacagtatagatagatatatatagtagccctgtagatttttttttcagacaaaaaaagaagaagaacgagatgaagtctgcaattcggttttggcagggcaaatcctgctggacgggcacgacctcaggtcgctggagctgcggtggctgcggcggcagatcgggctggtgagccaggagccggcgctgttcgcgacgagcatcagggagaacctgctgctggggcgggacagccagagcgcgacgctggcggagatggaggaggcggccagggtggccaacgcccactccttcatcatcaaactccccgacggctacgacacgcaggtccgtcccgtatagctagctcactagctgcactgccacttctctcgcttgctccccaccgttgctgcctgttgctctccaatccacttgtcggtgtctggaccacacgtgcctgcttgcctagctgctccacatctgctttccctgtccaaccttatgcaactcactctaatactatatcaaatacatttctagagtttaaagcttatcttagaataaatgcatctttagctacgagacaacctaacttcagttgttgttgttgttttttttactttctctcttctcacaaatactatgattacgtctttacagcgatcttttttattccaaacctaaaaatgcatgcactcactctaaaagcgcaaagggagcatctttttttcccccatcatctgcacgcagccttttcttttcctcatgtcacgagggactgaaggtgtgtatgcagcgtcaagtcatccatccgttccactccactcactcatgcgtcgcgcactctgcgctcgtgcctgcccggggctaaagctttagtagctagcctcagatcagatactgttcgtgtttgttaggccgcggcagctgcacatgagctcatgacagccggcagcaccaccaccaacgccatggaagaggggtcggggtccatcacatagacatagatgcctgttgtagactaggacgggagggcaattgttaggcgcctgttgccatcgcatttgctgctgtgggttgccaacaagtaacatgccaggatgctttgctatcacgcacaggacaggagaggtcctttttctcgacacaagctctacagcctctactaaactagcacttgctgatgagtgcagaggatgaatggacgatgaacatctagagtgagagagaaaaaaatgttaataataataaaaagtagtagcaggattaagaatcaacctggggtacgtaggaagaggtacaatccctaggaatctagagtatgagaagtatgggaggagttgggggagtgaaacggaacaaattccgagttggtattttgtcgggaatgtcaagttgatttttgatcctagtgcaagcaagaattatcaatcactcagactcagcctgtctgtgtctgtccaccccagctcttgctactctacttactactgtgctactagtggtagggtaggtatcttacataaactgttattataaactgtcatctgagaaagagagccagtcaaacccatgctgctgcttattttaatcactgtcaaatggcaggcaggcaggcagtctggttagttaataacatctgggaagggtttaatcaaaccaaatcaaatcagacgaaatctagaggccacatgggatggggccatatgtactgtactagcataactagcggctagattttattagaacacggactcacactcccataactataactgacttgatcatgattccttgccaagcaatgctcgcatgcccatgcatgcatcatccctggtcaaactcaaacactctccaccgtcagggaataagacttattattttattaacaattcaatttttatttattaattacgtctggacgaggagtactggtttatttgatgagagacatggcagtccaagtcaaactcgtttgtctgaccatggcggtgatggccggtgcaggttggggagcgcggcctgcagctctccggtgggcagaagcagcgcatcgccatcgcccgcgccatgctcaagaaccccgccatcctgctgctggacgaggccaccagcgcgctggactccgagtctgagaagctcgtgcaggaggcgctggaccgcttcatgatcgggcgcaccaccctggtgatcgcgcacaggctgtccaccatccgcaaggccgacgtggtggccgtgctgcagggcggcgccgtctccgagatgggcgcgcacgacgagctgatggccaagggcgagaacggcacctacgccaagctcatccgcatgcaggagcaggcgcacgaggcggcgctcgtcaacgcccgccgcagcagcgccaggccctccagcgcccgcaactccgtcagctcgcccatcatgacgcgcaactcctcctacggccgctccccctactcccgccgcctctccgacttctccacctccgacttcaccctctccatccacgacccgcaccaccaccaccggaccatggcggacaagcagctggcgttccgcgccggcgccagctccttcctgcgcctcgccaggatgaactcgcccgagtgggcctacgcgctcgccggctccatcggctccatggtctgcggctccttcagcgccatcttcgcctacatcctcagcgccgtgctcagcgtctactacgcgccggacccgcggtacatgaagcgcgagatcgcaaaatactgctacctgctcatcggcatgtcctccgcggcgctgctgttcaacacggtgcagcacgtgttctgggacacggtgggcgagaacctgaccaagcgggtgcgcgagaagatgttcgccgccgtgctccgcaacgagatcgcctggttcgacgcggacgagaacgccagcgcgcgcgtggccgccaggctagcgctggacgcccagaacgtgcgctccgccatcggggaccgcatctccgtcatcgtccagaactcggcgctgatgctggtggcctgcaccgcggggttcgtcctccagtggcgcctcgcgctcgtgctcctcgccgtgttcccgctcgtcgtgggcgccaccgtgctgcagaagatgttcatgaagggcttctcgggggacctggaggccgcgcacgccagggccacgcagatcgcgggcgaggccgtggccaacctgcgcaccgtggccgcgttcaacgcggagcgcaagatcacggggctgttcgaggccaacctgcgcggcccgctccggcgctgcttctggaaggggcagatcgccggcagcggctacggcgtggcgcagttcctgctgtacgcgtcctacgcgctggggctgtggtacgcggcgtggctggtgaagcacggcgtgtccgacttctcgcgcaccatccgcgtgttcatggtgctgatggtgtccgcgaacggcgccgccgagacgctgacgctggcgccggacttcatcaagggcgggcgcgcgatgcggtcggtgttcgagacgatcgaccgcaagacggaggtggagcccgacgacgtggacgcggcgccggtgccggagcggccgaggggcgaggtggagctgaagcacgtggacttctcgtacccgtcgcggccggacatccaggtgttccgcgacctgagcctccgtgcgcgcgccgggaagacgctggcgctggtggggccgagcgggtgcggcaagagctcggtgctggctctggtgcagcggttctacgagcccacgtccgggcgcgtgctcctggacggcaaggacgtgcgcaagtacaacctgcgggcgctgcggcgcgtggtggcggtggtaccgcaggagccgttcctgttcgcggcgagcatccacgagaacatcgcgtacgggcgcgagggcgcgacggaggcggaggtggtggaggcggcggcgcaggcgaacgcgcaccggttcatcgcggcgctgccggaggggtaccggacgcaggtgggcgagcgcggggtgcagctgtcgggggggcagcggcagcggatcgcgatcgcgcgcgcgctggtgaagcaggcggccatcgtgctgctggacgaggcgaccagcgcgctggacgccgagtcggagcggtgcgtgcaggaggcgctggagcgcgcggggtccgggcgcaccaccatcgtggtggcgcaccggctggccacggtgcgcggcgcgcacaccatcgcggtcatcgacgacggcaaggtggcggagcaggggtcgcactcgcacctgctcaagcaccatcccgacgggtgctacgcgcggatgctgcagctgcagcggctgacgggcgcggcggccgggcccgggccgtcgacctcgtgcaacggggccgcgtaggacggaatggatggatggatgggtttggttcctcgagagattgatgggtgaggaagctgaagctccggatcaaatggtggtactccatgatcgcaacaatgaggggaaaaaaagaaaggagaaaatacggtggttcatatgattgtacaatttgacgatctgtttgagtcggggttttaggatgatgtaaaccttcactcgccttttttttactcttgtttctcatccgcatcagtatcatctatctacatacagtgtcagagatgggaactgatccgcatcatcatctacctcccaaggcaccccagattgtattaatgtacttagttagcctgttttatatatacttataagtaccaaatagcagaattttactccttatctgcagtagcacgaaagaagaaacggcaagctacacctatctctggaagcaaaagaatctccccattctctctcttcctacgaggacaccccatccttttcagacagacagacagacggaccaaactgcaccacccaagaaccgatcgagagcagaggtagcattctctgcactgtagagtgtagaccatactacgctgctctcgagacatgatcccgggaatatctaccgaattgtttgtcagtggcatagccgcatagctctcagctgcctaatgaattgtttggtgccaaccgcgctgcaggcttgcagacgacccgggaagggtcagggattgcacaactactagcatcagtggagagcgaaaggccagaacggcaggcttgcaggaaaacagggaccgtgagtttgacctggccttgggggtggggagtcagtcagtcacatgcgatgcgatgcagtggaggaacccatcttccaacgcacgcggcacgccgtgacaccgattgatttcagggttgctttcgccgctgccaatccaccgatccctggaccctggtgcgttgttccttcgtcgcacatgacggtgcgccccaaccgcagcgcgctggctggcacggagaagggatggattggccgattggggatcggtgcatgctcccttgctcatgaagacggacgaactgcgcaaggccggacccggacccggacgggacggaggagtaggaccatggctgcctgggcctgggcctgggctcacagacagcacggaaaagaggtctgcgctgtccgtccctatctccccggtccaaatctcgagcgccgatgatgcgtccccaatctagccagccagcctatgcctatcctcggcaaccttgtcactgccatttcaccgctcgccaggcactgttgtcttgtcactgttgcctggcgacgcaacacaaccaggcgtctcctctagtcctctactcctctctctgcaacccaaacac

SEQ ID NO: 576 - protein, 316 aa, Zea mays
MVLMVSANGAAETLTLAPDFIKGGRAMRSVFETIDRKTEVEPDDVDAAPVPERPRGEVELKHVDFSYPSRPDIQVFRDLSLRARAGKTLALVGPSGCGKSSVLALVQRFYEPTSGRVLLDGKDVRKYNLRALRRVVAVVPQEPFLFAASIHENIAYGREGATEAEVVEAAAQASAHRFIAALPEGYRTQVGERGVQLSGGQRQRIAIARALVKQAAIVLLDEATSALDAESERCVQEALERAGSGRTTIVVAHRLATVRGAHTIAVIDDGKVAEQGSHSHLLKHHPDGCYARMLQLQRLTGAAAGPGPSTSCNGAA

SEQ ID NO: 577 - DNA, 7285 bp, Zea mays
aaatacattacggatatatatatggttccagttggcccgggacacaatccaaaaccgaaacggatgaagttttacacgaagaaaacccaatatgctgaaaacaacaacgacttaaccaaaaggtagacctcacctcagatatatacaaactgaacaggtcaccatcccggtttgccttgatgtcttttcttcccatgtaatacaatatatattccatttaagggctagtttgaaaacttcattttctcaaggtattcctatttttccaaaagaaaatattaaattttcttaagaaaataaaaatattatagaaaaatggggttccaaactagccctaaaatagtcacacaaggaatattacgagtgtcgtatatgcatgctagtttatgtgcatttattttaggacggaagtcgtctatgtttttagtccaaattaataagtaaaactgaaatacattcaatatatatacccacaacttcaggcccaagaatttgtagggttcagggacgacgagcagttccaaaaaaaaattggagctttagttgtgccacaaacagtcccctatccctatacatacgtccaaactaaattgaaggacttcgagtcatcaaattgatcgatcgatcgatcgccctttattggagcgatcgcagtagagctgagatgatatatatatctgttcatcaatcacacgcgcacataggcactagtaccctgccacagggaggtagcagcagtggcggtggatcgatgagagaggcgcgtgattggatggacgcagcactccaacgtccaaccatgcgccccgatcgagatgatatgagcggcagggtgactgttcctttcccttgaggtgtacacttgcatgcatgagcgatcgagcgggagaccgatcactgtacaagggttaggccggccgtgtgcgcgtcttgcttgtctcgaaaagatttatggtgatgcaggccagctccgctcgcctgatcgtcgctgcgtggtaggtctcgtgtgtacggactaccccatgtgtgcgtggggcccaggcattattgcaggaatagaaaccctaccaccatctccgctcgtggcgtgctccactgattcttcttcttcttcttctacctcccggccggtctcctcccctttctttgtctgcctgtgcttattagtatctcgcctcaccacgcagctagctagcagacagccagacacgcgctgctttcagatatctcaccggaccgtcgtcgtcggcccctccgagaacataccaccgcgcccgccgccgcgcgcgccaccacgtccacgtacgccggccggccaccaagcaagcatggatacggtttcacagtccgagcacctgtgctacgtccgctgcacctactgcaacaccgtgctcgcggtaaactcctcgagaaatcggccggaccctaataatgaaacatctatcatataggccaggaagatcgtcatgagatgagacgatacggctagcaccagatatggcatttcttccgctcgtttttgctaaactcagacaacaagttttctgctacctggttcccatttttttctcttgcttttcttttctttcctggatatgtatatccttgctttatatcatgatggtggtagccagtgccgctgctatctctcattcatgtacatggcaaccaattaaaatccagcctttctctttcttgccttgagattggatgggcgcacacatatacatcctgacatgcatgactgatgtgccacacatgtttccttggagaggtacggtgtttcgttggctctttgttgattctttgtagaatattccgctcacgctgcttctcctgatagtgtgacatgttccgtctttacttctatgtatatatgtttggtgcttcgcaagctagggcttcaaatatcttctcttctttgttgttacatgcatactgaagttcaaactggacaagaatcttctgtttactctccggccgctgcctatatcgacttctagagctcatccctcagtttctttctcctcgagatttatattctgctactgctgcttcgatcgacagtgccatgtaaataggaaaggagttgatctgatttcatgctgtgattgattgattttgtgcttcttgggtagctgcaggttggggttccatgcaagaggctcatggacacggtgactgtcaagtgcggccactgcaacaacctctcctacctcagtccacggccccccatggtgcagccgctctcgccgactgatcatcccttggggccattccaggtgtagatcaatacagctcgctctttagttcgtcttctttgaatatgttagcttttttggagaatgaaaaaataataatatagatgatttcacaaatagatcaatggagttttctcatgaaatatggccatggatttgctttttttactttctcagctgcatccgtgtgctgctactttgctatctctctcctttattgaactactcaaagtactgtttgcaaggcaagattaaacaacgctggactacaaaagatttctttttgctcatctctctgcgcgcggcctggggaagccgtcgctcgttgctgcaaaaggcagtgttgagcttttttgaggcggcagggagctagcagcagctgctctgctctgctgcagcattcatgcatgcacggttctcctataacacattttcttttggacataaagatcttggtatccttgaccagatttgatggccatgtaaacaataactaggaaatgattccatcacgtatcatgatagattcatcggtaacgccgtgagatgttgaagcgctgggacctgtccttgatcgctatgctgccatttctcagtgtcagggaccctgcagtgagtgcaggaggaaccaaccgctgccgctggcctcgccgacatcgactgacctcaccccgagaatgcccttcgttgtcaagcgtaagtagcagcagcaagaagcaccatcattttgactgttccttgtacctttgttgctttgttttttttttctgttcttaggtgattttttaagaaaactttcttctcaaactctatctatccctcctgtgttagttgatgtgattgagtaagatgaacagtagttaaggttgttcttgtactcaatgcatttgttttatctttcattgcagccccggagaagaaacatcgcctcccatctgcttacaatcgcttcatgaggtgaagagacatttgttttcttttctttttaaatttttgcaaatacattgtttggaataatagtttttcaaacatatctggtctcaaatagtttcatgtgatctcaccgtgcttgttggagtcaagttggtatctctctatgtatttagaaatctgatttacttgtaatgcctgctccaaactctgaactaattaagggcctgtttggatcccagtaactaaagcacaagtgacttaagtttagtcgtttttgctttagctcctgtattcaaacaggtcctaggttcatgaaaaagttgaactaaaatgggtttgaatccaccatatatggatacctcactctccgccccttacacactttcccctaacaagctaggctacataagcctgagtattactattttcacaatagctgaagacaatgcttaaaatgtgacatgaactttctcctggatccgtcagccagccaagtttacaaatactccaacgcatatcatttttttacaagtactcaagtactagtcaagtaggatagtaggagctccgatccgaacgcagcagtaactagctaaaccgtgtgaatgtatatatatatatatagttcacacattgtttttgctatatacccgatgcatcattgttaggtcggcactaaacctcttctaaaaaaatctagaggaactgtgaagtgcaaccatttaagaatgatctcatttattactcccctgttccaaaatagtagtcgttttagctctaaatttttatgtctatatttatatggatgataacgaatctaaacatatatatatatagaacacatatattatttattatatgaatctactaaaagggtaaaacgatttttaatttgcattgggacagagggagtattagaaaaaggttcactctgggttttattattttgcatcaaactatgtcattgctttatgttgaggtccataagtttgtgctcttagtagatatatatccctccatcccaggatataaattaagcgtaactaactctggtttaaagacaaaaaatatatttattttttcctttcaacactagtactactaattcgatatacatgcctctagagatagcgcgtctatatcatgaaacaagaataaaaaatggttatgcattattatattagcggcggagggagtatagccgttccattactatgtattttctagatatatattagtctagccagatacttttatccaaccttttccaagattacagcagttgggatttagaaagtaaatgtctggatagtgattccatactggttactggttgtacaatgaatttaaacagaactttagaacaatcaatacactcatgccatgcaagcaaacatactgggacgatggaatggaagatactaatttcccttgaatctggaagaataagaaaagacaacacaagcacactatataacctttatttcatcttatatacagggatgaaatcaaggtgatactactatgtaatcttcattgcattgtaaacattcattttgggtcttgaatttctatatttttccctcaaatattctatgagaagtagtagatttgattatttttagaaaatagaaaataaacgaaaactacttgtcacaaaccaatagcatacaacaaataagaactgccccatacacataatacagactcatgaggatagacattttgaaaagactggacttaatgacacgttccgcctgagatcttatacactgcattattgctgaatagttatgattgcttacattattatttgtagtttcacctctttactaatcgctcaacatgaaatttatttttaaaatttaataattgtatcgacacaattactaataatagttgaatttgatgttccgtccctgcgtttttgtttaaatttgctattaggcacacacacacttcaagatttgaacccttcattaaccaattagcctaaaaatttgtacaccgtagtgtacgacttttgtaccattgagctcgtatttgataatgcttttgtacagtattatttgttggtcatgaacaataatgcgatttgagaggaattaacggccagaggtcttattagaaattgcatgggtcaaaaaccaccgtacattttgaagcggcagggggtcatttttaaagtgaaactattacattgttgtgcatttgtatgattacacaaaataaaatatctgtacaataaaatattttctttgtttcttttagaggtcgtatacatattacattttgtgaaccatatctctcttctgtaaagaaaaatcaagacaggcttgattttccttattgactagatatatatgttaccctttacattacatgcttatgcggcagggaggagattcagcgcatcaaagctgcgaagccagatatccctcacagggaggccttcagcatggctgccaagaatgtgagattgcttcttggttctaactaattcttgaaagcaattttttttacatatcttttctctatatatatgcatgcatgcagtgggcgaagtgtgacccgcgctgctcgacgactgcctctactgccacttctaacagcgctcctgagcctgctagagtcgtcgtgcccactcctcatgtaactgagccacgctttgatctggaggtactgcagaactactaggccgtctctcttgatcttctctatacatttatatagaggcagataagaaataaagactccaatatgctatgctatttcttactacgtacatgcatgcatgcataatgctgctcttgcaggatagggccaaggagcatgtcattgagagcttcgacatcttcaagcagattgagcgcaacatctagatgtctccatttcgagtaccatcagctctatatataacctatgcatgcatatgcatccccatcttgtactttttacccccatgttactgttgctattattcttgctcttgttggattgtacgcaccctttaattgacagttgctaccctatataatgtttgccatcttatatattgtcgtcgttccttatatagggttatgatcgatatatatgtagtgtgtgcaataatttgcattatattgtgttgaattaactgaaacaaaatgcagtgtttagtgacaaaataataaactaatactcctccgttccaatttataattcgtttgaactttttatcctatgtttgaccgactcgtcttatccaaaaataataatcacaattattataattttttactctagtattgtttagcatataatatacgttaaatttggctttgatttttcagtttttcacggaaaattttgaataagacgaggagtggcggatctacatccggggccacccggtccgtggcccggggcttgatccatgtaactctatataagtctccatttaatacggtataaaatagttaagataaaatgaaaagaagaaaatttgatagatttggcccgagtcaaagaaaaattctggatccgcccctgaagacgagccagtcaagctcggtcgataaaagtcaaacgaattataaattgggacgcatcatgcgtgtatatatggatggaggagtatatgtcatagaaatcatctttcaatatatgtagagtaggtacttttttagatcacatgtgtagcagattctaagatattaattttcttattttctatatcgcatgacctgtcaactaaaaaaacagggggcaatatttttattatgttaaacatatcattactatttatactagttgcattgtttggctaacctcacaaaaaattgatgtgatgattattttacaaaatgagtccatagtgcttttaggtcttaaaatatatcaccatgcatacaggtgatgatcttaattacatttagtagacaaattttatgcaaagcgacactagattatttttgatgagctaggtagaataagtatagtttgatctatatgtatgcatgcatgcaatattgcatgacagaataataatgcaatgacataacaattgaattccataagaaactcaggtataaataatagtaatgatggaa

SEQ ID NO: 578 - protein, 206 aa, Zea mays
MDTVSQSEHLCYVRCTYCNTVLAVGVPCKRLMDTVTVKCGHCNNLSYLSPRPPMVQPLSPTDHPLGPFQCQGPCSECRRNQPLPLASPTSTDLTPRMPFVVKPPEKKHRLPSAYNRFMREEIQRIKAAKPDIPHREAFSMAAKNWAKCDPRCSTTASTATSNSAPEPARVVVPTPHVTEPRFDLEDRAKEHVIESFDIFKQIERNI

SEQ ID NO: 579 - DNA, 5314 bp, Zea mays
  misc_feature (1)..(994): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccaccacaccacaacgccacaatcacaatgcctcctcccaccttcctcctcggcctcctcctcctcctcctcctcgccgccgccgcccccgcccccgcctccgccacgccggagcgggacgcgtacgcgctgtcgaggctcaaggcgtcgctcgtcccgtccgccacaaactccacctcggcaccgctgtccgactgggacccggccgcgaccccgccggcgcactgcgcgttcacgggcgtgacctgcgacgccgccacgtcgcgcgtcgtcgcgatcaacctcacggccgtgccgctccacgggggcgcgctcccgcccgaggtcgcgctgctggacgcgctcgccagcctcaccgtcgccaactgctatctccgcggccgcctcccgcccgcgctcgcgtccatgcccgcgctccgccacctcaacctctccaacaacaacctcagcgggcccttcccgccgccgccccccgccgcctacttcccggcgctcgagatcgtcgacgtctacaacaacaacctgtccggcccgctcccgccgctgggcgcgccgcacgcgcgctccctccgctacctccacctcggcgggaactacttcaacggctccatcccggacaccttcggcgacctcgccgcgctcgagtacctgggcctcaacggcaacgcgctgtcgggccgggtcccgccctcgctctcccgcctctcccgcctccgggagatgtacgtcggatactacaaccagtacagcggcggggtcccgcgcgagttcggcgcgctccagtcgctcgtccgcctcgacatgagcagctgcacgctcacggggcccatcccgccggagctcgcgcggctgtcccgcctcgacacgctcttcctcgccttgaaccagctcacgggggagataccgccggagctcggcgctctcaccagccttcggtcgctcgacctctccatcaatgacctcgccggcgagatacccgccagcttcgccgctctcaccaacctcaagctgctcaacctcttccggaaccacctccgcggcgagataccggccttcctcggcgacttccctttcctcgaggtgctgcaggtgtgggacaacaacctcacaggccccctcccgcccgcgctcggcaggaacggccgcctcaagacgctggacgtcaccagtaaccacctcaccggcaccataccgccggacctctgcgccggacggaacctgcagctgctcgtgctcatggacaacggcttcttcggcagcatccccgagtcgctcggcgactgcaagacgctcacgcgcgtccgcctcggcaagaacttcctgaccggccccgtcccggccgggctcttcgaccttccccaggcgaacatgctcgagctcaccgacaacatgctcaccggcgagctcccggacgtgatcgctggagacaagatcggcatgctcatgctggggaacaatcgcatcggagggcgcatccccgccgctatcggcaacctccccgcgctgcagacgctgtccctggagtcgaacaacttctctggcccgctgcctccggagatcggcaggctcaggaacctcaccaggctcaacgccagcggcaacgcgctcacgggaggcatcccgagggagctcatgggctgcgcctccctgggcgccgtcgacctcagccggaacggcctcaccggcgagataccggacaccgtgacgtcgctcaagatcctgtgcacgctcaacgtgtcgaggaacaggctgtcgggcgagctgccggcggcgatggccaacatgacgagcctgacgacgctggacgtgtcctacaaccagctgtcgggccccgtgccgatgcagggccagttcctggtgttcaacgagagctcgttcgtgggcaacccggggctgtgcagcgcgtgccccccatcgtccggcggcgcgcggtcgcccttctcgctgcgccggtgggactcgaagaagctgctggtgtggctggtcgttctcctcaccctgctggtcctggcggtcctgggcgcgcggaaggcgcacgaggcgtggcgcgaggcggcgcggcggcggtcgggggcctggaagatgacggcgttccagaagctggacttctcggcggacgacgtggtggagtgtctcaaggaggacaacatcatcggcaagggcggcgccgggatcgtgtaccacggcgtgacccgcggcggcgcggagctggcgatcaagcggctggtggggagagggtgcggcgaccacgaccgcgggttcaccgcagaggtcaccacgctgggccgcatccggcaccgcaacatcgtgcgcctgctcggcttcgtctccaaccgggaggccaacctgctgctgtacgagtacatgcccaacgggtcgctaggcgagatgctgcacggcggcaaggggggccacctcgggtgggaggcccgggcgcgcgttgcggcggaggcggcgcgcgggctctgctacctgcaccacgactgcgcgccccggatcatccaccgcgacgtcaagtccaacaacatcctcctcgactccgccttcgaggcgcacgtcgcggactttggcctcgccaagttcctcggcggcggcggcgccacgtccgagtgcatgtctgccatcgccggctcctacggctacatcgccccaggtaacaaaactctcgccgcatagcagcataaccacgtgtttgtactccttttaataatatttttttcactggctcgcatgcagagtacgcgtacacccttcgcgtggacgagaagagtgacgtgtacagcttcggcgtggtgctgctggagctcatcacggggcggcgccccgtgggcagcttcggcgacggcgtggacatcgtgcactgggtgcgcaaggtgaccgcggacgccgccgccgcggaggagcccgtcctgctggtggcggaccgtcggctggcgccggagccggtgccgctgctggcggacctctacagggtggccatggcgtgcgtggaggaggccagcacggcccggcccaccatgcgcgaggtcgtgcacatgctctccacctccgccgcggcccagcccgacgtcccccacgccttgtgcaaggtcgtcgattaatttgccttatatatgacgattatgtatatgatccgggcagggttagcgcctgtgatctatttagcggctgcctttttggcgtcactcgtctcgtgtgtgatgatggctggatggatgtgtaaaacaaataaccagcaggtggctactcgtgaatgaaagttgccggttcttattctcatgcatatatattagcaacacacaaagtgagatggcatatattccctttccctggcgtttgttgctttgggttattcgtcttggcttctcgcggaaggtctttctgctgttcttgaacgacaggatagtatagaggcttctatgagaaagatgcttcatgctgcgaaagttgaaaatggcagatgcacattgcgtatccccacagggcaggacactttgcgcatggcctagtactaacacaatccatggagcaaggaacattactgcccttggcctccaagctgcttccttaatcatcaaggatgaattaggaaaaaaaaggataaacggaccgccatgaccagagccagtgagggagccacttcacctgccgactgcaatcgacggcccacccgtcagccagagagaaacagtccaccgcggttggattggacgacgagatctcaacgtggggcggtccgagccgggcgcacgcgcacacgcgcttctcaactcccaccaatattaccctccatatatcaccgacaggtgggacatcaaccaagccggtacccaacaacagcacagaaaaccccacaggtcatagacagcggagctccctccagtctccatccaataacacgagctaaccaccgcccaaccgaaaccgggccccaccggtctccccgtcgccacgtacgcggccggagcgccctatacaagcgccacgtcgatcgccgactcgccgtcgccgcgtcccccacggctcttccttcatcctccggcgagctataaatccctcccgccgacgccacccccatggcatcccgcggttccccttcctcctactcctccccgaggaccccgacgtcgtcgaaggctaacccttggcccgcgccctccgccccgccgctgtacccgacgctctccatggccgacctcgcgcccgtcgagatagggcccgcctcgtcgccgacggcctcggatgactacaacgcgcctccgccgtctgaggacgtcctcctccgggtccccggcgcgcggctccacctcgtcgacc

SEQ ID NO: 580 - protein, 996 aa, Zea mays
MPPPTFLLGLLLLLLLAAAAPAPASATPERDAYALSRLKASLVPSATNSTSAPLSDWDPAATPPAHCAFTGVTCDAATSRVVAINLTAVPLHGGALPPEVALLDALASLTVANCYLRGRLPPALASMPALRHLNLSNNNLSGPFPPPPPAAYFPALEIVDVYNNNLSGPLPPLGAPHARSLRYLHLGGNYFNGSIPDTFGDLAALEYLGLNGNALSGRVPPSLSRLSRLREMYVGYYNQYSGGVPREFGALQSLVRLDMSSCTLTGPIPPELARLSRLDTLFLALNQLTGEIPPELGALTSLRSLDLSINDLAGEIPASFAALTNLKLLNLFRNHLRGEIPAFLGDFPFLEVLQVWDNNLTGPLPPALGRNGRLKTLDVTSNHLTGTIPPDLCAGRNLQLLVLMDNGFFGSIPESLGDCKTLTRVRLGKNFLTGPVPAGLFDLPQANMLELTDNMLTGELPDVIAGDKIGMLMLGNNRIGGRIPAAIGNLPALQTLSLESNNFSGPLPPEIGRLRNLTRLNASGNALTGGIPRELMGCASLGAVDLSRNGLTGEIPDTVTSLKILCTLNVSRNRLSGELPAAMANMTSLTTLDVSYNQLSGPVPMQGQFLVFNESSFVGNPGLCSACPPSSGGARSPFSLRRWDSKKLLVWLVVLLTLLVLAVLGARKAHEAWREAARRRSGAWKMTAFQKLDFSADDVVECLKEDNIIGKGGAGIVYHGVTRGGAELAIKRLVGRGCGDHDRGFTAEVTTLGRIRHRNIVRLLGFVSNREANLLLYEYMPNGSLGEMLHGGKGGHLGWEARARVAAEAARGLCYLHHDCAPRIIHRDVKSNNILLDSAFEAHVADFGLAKFLGGGGATSECMSAIAGSYGYIAPEYAYTLRVDEKSDVYSFGVVLLELITGRRPVGSFGDGVDIVHWVRKVTADAAAAEEPVLLVADRRLAPEPVPLLADLYRVAMACVEEASTARPTMREVVHMLSTSAAAQPDVPHALCKVVD

SEQ ID NO: 581 - DNA, 4284 bp, Zea mays
cggaagacagactcgacctcggcttcggaggagcctccacatcgcccaacctagggcgcaggccagccacgtcaacaggaggcgccatcatcaccctaccccgagctgactcgggccgcagggaaccagaccggtgtcccatctggctagctccgccagataggcaatgaaggcgccccgcatgctctgtgacgacggcggctctcagcccccttacggaagcaagaggacgtcagcaaggacccaaccgctccgacagctgtccctccgccaggctccatcgctcctccgacggccacgacatcgcaccagctgggtgccaaaatctctccggctgccacgacggcatgtacttagggcgctagctctcccccgctagacacgtagcactctgctacaccccccattgtacacctggatcctctccttacacctataaaaggaaggaccagggccctctcagagaaggttggccgcgcggggacgaggacgagacaggcgctcgcttggggccgctcgctccctctcccacgtggacgcttgtaaccccctactgcaagcgcacccgacctgggcgcgggacgaacacgaaggccgcgggattcccacctctctcacgccggtctccggccgcctcgctctccccccttcgcgctcgccctcgcgctcgatccatctaggctggggcacgcggcgacactcactcgtcggcccaagagacccccggtctcgaaacgccgacaatatgatatatagaaactataatgatacacatgcaattaactagtgctgataatatatttacactgtagatttttccgataagtagaaaccaaatatttcaccgccacaaaaggcttcatcccatcagttacccatgtagcaaaaccaaaatacttgtgtgcgagaggccaagagcccaaaccaccgccaaggaaacccccagcccaccaggcgccttcctctataaataccctaactccggtggccgaagttcctcacccattcactcactcatctcaaggcctaggtagcaccgtagcagctactagaagcagctagccagaacaactcgtccatggcgatggcctccgcggcttgctcatgcacggacggcacgtggtgggtgtacgcgctcccggcgctgctcggctccgacaccctgtgcgcccacccggccctcctggctggcctgatctttctggccaccgtctcggtggctctgctggcgtgggccacgtcgccgggcggtccggcgtggacgaacggccgcggccgcctcggcgtcactcctatcgtgggaccccgtggtctgcccgtgttcggcagcatcttcgcgctgtcccgcgggctgccgcaccgcgccctcgccgagatggcccgcgccgcagggccccgggccaaggagctcatggcgttctccgtcggtgacacgcccgcggtcgtgtcgtcctgcccggccacggcacgtgaggtgctcgcgcacccgtcattcgccgaccgccctgtgaagcggtcggcccgggagctcatgttcgcgcgtgccatcgggttcgcgcccaacggcgagtactggcgccgcctccgccgcgtcgcgtccacgcacctattctccccgcgccgggtcgcctcgcacgagccgggacgccaaggtgacgcggaggccatgctccgctccatcgccgccgaacagtcggcctctggcgccgtcgccctccgcccgcacctccaggccgccgctctcaacaacatcatgggcagcgtcttcggcacgcggtacgacgtcacatcaggcgccggcgccgcggaggccgagcatctcaagagcatggtgcgcgaggggttcgagctcctcggcgccttcaactggtccgaccacctcccctggctcgcccacctgtacgacccaagcaacgtcacccgccggtgcgccgcgctcgtgccgcgcgtccagaccttcgtccgtggcgtcatcgacgagcaccggcgccgccgccaaaactccgccgccctcaacgacaatgctgacttcgtcgacgtgctcctctccctcgagggtgacgagaagctcggcgacgacgacatggtcgccatcctctgggtaaagttcaaatcgatcgctttcctagcttgtttaactgcgcatacttctcagttctcaactgcgcatacctgtcggttctacagttttgtgtcgggctgtcggttgttcccggaagggaaaaaaaagaacaaagctctgtcgctgaaaaaaacatactgtacatgcatataatttgtttttgcaggagatggtcttccgcggtacggacacgacggcgcttctgaccgagtggtgcatggcggagctggtgcgccacccggcggtgcaggcgagggtgcgcgccgaggtcgacgcggctgtcggtgccggaggttgccccaccgacgccgacgtggcgcgcatgccgtacctgcaggcggttgtgaaggagacgctgcgcgcccacccgcctggcccgctgctgagctgggctcgcctcgccaccgccgacgtgccactctgcaacggcatggtggtcccggctggcaccacggcgatggtgaatatgtgggccataacccacgatgccgccgtgtgggccgacccggacgcgttcgcgccggagcggttcctgccctccgagggcggcgccgacgtggacgtccgcggcgtcgacctccgcctggccccgttcggcgccgggcgtcgcgtctgccccggcaagaacctgggcctcaccaccgtgggcctctgggttgcccgcctcgtgcacgccttccagtgggccctgcctgacggcgcggcggccgtttgcctcgacgaggtcctcaagctctccctggagatgaagacgccgctcgtcgccgcagccatcccccgcaccgcctgatccgtcctgccgccgacgcgtcacgtcacgcgttgtttgcatggatgatggtatctttgtctgtctgtgtggtcttcgctaaagtttgcttcttctcgatcgtcggttcgttcgtgcctccaccttagcctagggtttggtttcttgcaaggtagtgagtgtgtcttagtctcaccatcaccggggctccaattttggaaagctgcgtgttaggagttaacccctagacatgtttgcgtcttgatcgccaccacccatcagtatcagcgcagaaactacatatagatcagtgtttgtcgaccagtcatggaagtcgtgtgctctcaagtctgatgtattatatacatatatatgtattgtaatgtgattatcaagaaccgtgctatttacatattgctgtttaattgaactaattaactaaatgtcccttatatatatgtccagatcggccactaattaactagttattttacaaatatttacaagtcggtcgtcttaagaaatcaacgcacttcaacagtattgagccgtctggtgtcaaatgagacttgcgttcactaaagaacttaatcaggttctttttgaagcacgtatttcgattgcctgctgctggctgtaatatatcaattcaagcacttaaacaggttctttttcagtgcaacaagggatgtagaggtgccatggtttgggtaagcactcatttctgtggtttatagttcgtgagtagttccttatgtgtttgcctgcccctggttgtaatatatgataatgcagaacaatctcttgcaatactatagggccctccattctaatttatagattgttttggcctagtcgattaactgttcatgaacatctttattggatggactaaccaacgtcggcctaagtctaggggaaaaggcccaaccagcgccatgagtagatcagcctgcaccagcgtgaacagtgaaggcaggcccaaccagcgccagcatcagatcagcccgcaccagcgcgaacagtagacgagtgaatagtaaccgagtgaacgaaggcaagagctaaataaatatgacagtttctatatttgtatatttatcttaggagtcaagttgattagtttctatatccattggattagagtttaggtaagttaaatatgtaacttgaggaccaaattgatgcctgccaaggctatataaggacctagattatactctcttaaattgagtttcaatccaatctgatgacaaaatcacggcacagaccaccgaggtgtcctccctgaaagtcgaccaggttgtttgtattcacatcgccgtcaacaatatgcagtcccaaacaagtggatggtaagcacaggctcactacggaccacatcgcctctgcc

SEQ ID NO: 582 - protein, 548 aa, Zea mays
MAMASAACSCTDGTWWVYALPALLGSDTLCAHPALLAGLIFLATVSVALLAWATSPGGPAWTNGRGRLGVTPIVGPRGLPVFGSIFALSRGLPHRALAEMARAAGPRAKELMAFSVGDTPAVVSSCPATAREVLAHPSFADRPVKRSARELMFARAIGFAPNGEYWRRLRRVASTHLFSPRRVASHEPGRQGDAEAMLRSIAAEQSASGAVALRPHLQAAALNNIMGSVFGTRYDVTSGAGAAEAEHLKSMVREGFELLGAFNWSDHLPWLAHLYDPSNVTRRCAALVPRVQTFVRGVIDEHRRRRQNSAALNDNADFVDVLLSLEGDEKLGDDDMVAILWEMVFRGTDTTALLTEWCMAELVRHPAVQARVRAEVDAAVGAGGCPTDADVARMPYLQAVVKETLRAHPPGPLLSWARLATADVPLCNGMVVPAGTTAMVNMWAITHDAAVWADPDAFAPERFLPSEGGADVDVRGVDLRLAPFGAGRRVCPGKNLGLTTVGLWVARLVHAFQWALPDGAAAVCLDEVLKLSLEMKTPLVAAAIPRTA

SEQ ID NO: 583 - DNA, 3001 bp, Zea mays
gggtttttcccattcaactgtacattccaagttgcccttgttctttgatggtcgctttggtgcgtttagttgtctacatatagcctggccaggaccctttgtttggttgctcttgaccacagcctctatagcctgctattgtagacgcaaagatttcttctagctaggcccgcctctcgagatacacgcatggaatgagctttttttccagagccaatctctactggtgcaaaccatgagccaatctctactgattgtacatgccctaaaaatggattagcatgtaattattgcctgttaaatgattctaattcattcgaaagtgattaagactcaaggcttagtctaaattctatactcttgacaatgccatctcttgaaaacataataaactttaataccatttaagctcatataagcaatcaaacaacatctctaaataaaaaaataggctcgaccatgttcagacttggagccggattcagtagtttaaaaaccaccgagtagttctccttgtgctttcgggatgttcaaagactgccacctcactcatggagatgtctgctgcacgaacttgctgaggtacaaaggctctatgttgcacttccactttggttttgagggtaataaaaggctgaagacattttgaagttcaaatcttcgagtttctctaccgtttccaagcggaaaagcgaaaaggaatccatgctgtggcaaagctgtaaaatcgtccaacggctcggactaccagctgtctgtgacgtcagcgagaggcgagaggacggccgctctcggcgctcgctcgcgccagggtgacccccgggcggccgggccgctccacctccgtctctggatcgcgggtcccacgcatacggcgctggcctcgacggcgcggcaggactgctctccggcctccgggcgtgatcagcgcacccgatgctcgccacgtgtacccgcggcacgtgaccgtaccacggataggggagcaaaccagcaaagcacctgccacctcgacgcgacgcgatttcgtttgagtccccaccagacgggcgaaaccaactctctgcggcagagggcggacggcagagggttttggagcaggcaagcctggctcttcttgttcctccatctcttccgtcgccttgcgcgtgttggcggctgcgtacgcgaggccgccgcgtctggccggatggctcacgcggccgtcgtcgccttgctcgccgtcgctgtgatcttggcctgcttgccgccgcccgccgcctcgtcctaccggggaggtacgtaaaacgcgcgcccgcgcgcatcgcaaaccaaaccgtgttttcttggttcttccgggcgcacccaaaacctgacgttttcgcccgcggcacagcggctgcattgcgacggctcgagacagcggagcccatggacaccgcgcagggcttgcgggagaaggcggacgtgaacaaggtaaaaatacaaagacgcccgccgccgtgctgcgggctagggtcaaggaaaggcggctcttttttctgatggtctttttcgattctccggctcgatcttccggcgtgcagggcgcggaggaggacctgagcacgacagggttcggcgccgagtcggagagggaggtgccgacgggaccggaccccatccaccaccacgcccgggggccaaggcggcagtcgccttgatcgtcatgcgcgcgcgacacggcggcggtggatcctcgcttcctggaagtttgtggtcttgatcaggcgggcgtgaaccggattccacgatgatcctgctctttctttgttcttaaatgtatctgccatgcacctttggttctaattccattgttgtagtagggaagcagcatccacctatcaactatcatcaaaacccccctatgttttggcgtgccaattagagaaagggaattacagcgcgattcatataataagtgtgtacaatgaattccacgtatgagttgttctttccctcgtaattttgtcatcttgttttgttgctggttcattctttgattgatgttctgtctgtggttgctggctggtttggtttataaatgatcggcttgccattgaacgtctttgcattaatgcctgattgttcaagttcatattgtgggatgggaagcaagaacttccgtgttttttttttctgctaatcccggaagaaagcaactttgttcggttcgttgttttggcagagaaagaagtacgctgtagtgaggactaactactgtatggggcctgcgcgccgcttgtcttaaagctaaaaggggttatttttatataaaaattacgaacaggatcgagttcatgtctctttatctctggactgcttagcttgatttgcttttatttgcatcattatcagttcttcttgcccaagtaaggaatcaatatattatattacaatcacattcaacaaaacttttttctggatttcattgaaatgggcctcaagtactcaaagtaactgcattttacaacaactttgcacccaaccagtgaggtactagatagtgcttgatttatgtgatttctctcaaaacagatgtgtatgcaactatgcatgcatgcatgatgtttttaaagttgtcagattaacaacagcctgcatgtagtggctagttatgaattttggcttgtgttatcaagaaaatgaacttggtcacatgtttgtttcagattataatctagagacattatataatccaacgtaaataatctaacgggtaaacaaacacctagattgtaggtccagattatataatctaatacctatattatgatattcttataatctcgtaagagtagcttatttcagattatttttggcaaaagacctagtactcatagctatgtacatcaaaattacaaaatatatatcgttttcttttatccgatcagccaaatccctcccccgatggcgcttcctccaacctatagatggtcaaatgggccggcactaagcacggcacgacccgtaatgcttcagt

SEQ ID NO: 584 - protein, 94 aa, Zea mays
MAHAAVVALLAVAVILACLPPPAASSYRGAAALRRLETAEPMDTAQGLREKADVNKGAEEDLSTTGFGAESEREVPTGPDPIHHHARGPRRQSP

SEQ ID NO: 585 - DNA, 6911 bp, Zea mays
ttcaggaacaaaagctagcggggttgctactaattgctactgttgttgataaacacgtcctgatcagacgccacttgcttggatctgttttaataataataataataataataataataatattattattattattattattattatttcctttgctttctttttttgaactgattcttttgtatgttgcaataataatgttaaaagacaaaagtaacggcagggagttgcagatagacctaatatcaaaggctgtcagggcccttttggaacgcagggattttcacttcacaggtgcttttttttatgaaaatgaaccggttcttatgatttctttttttctatgtttcatcatacgagtggaactcgaacatccatcccaaatattagaagacaaaagtaacagtaggagagctgagaagcctgagatagacccaatatcaattaattaaagacttttatagcaaatccaaaaggatgcaaaaacacccccgtcaaaaaaataattattagggacaggttacatttttttggaggcaaatatggtgcatacttcaacagttttattcaaaacaaaggctaaaagaccgtaaaccgagcctatattttttttaaaaaaactagatccatctgccccattccgcaaacgattggggagacactacgtcgctcaaatatgtgggggtgggggggggggataggttgaaagcgggttaccgtatttttccaacaatgatggatccgtcgggctgatttggtgacaaggggatcccggaaggattgaagagaattgaggggaaaatgaactaatttccctctccattatctcgggatccagggtcaccaaatcaactctaaatctgtttttcgggttgttttaagtgcttttggagttactcttatacgaatttgagtcatttttttttaaaaaaaagataaatcaaaatatacattagtctgtacatagagtgactgctctgaaaaaaataaaaaaactgtagagacaccttagccccaataattgtagcacaggcaacaggtgcacagcacaacatagccccattgcatgcatggctgcagtgtgacacatggcggtggggccctgcccactgttcctccttcagggacggaaaggttggttgcggccccaccatggcgccaagtaatatcgccgctgctctctctctctcttttcatgcacacgctcctctctccctccctcccaccattgctacagtcgcagctgtctgtgtctgcaaagtactgactgctcccactccactccacccccagttccgggccactcgggcatcgtttctgttgctgcaaatctttgttggctgctgctgccttgctatctatctatacaccgcccgcaccttccattcctcctcctccgaagcagcaggcagcagctgcatcgcacctcacacctctcgtgtccatcgatccagccgccgccgcagctgcagctctcacttcactgttgctgtgccacctcctcgtcgcctgtagtgtctgtcgatagataaacgcccgcggaatgagagggaaggagcggaagctgcagcgggcgcgcgcgtgcaagggctaggactagcggttgcaacgtcggcgcgcgcggcgtacgtcgggcatggattgggatctcaacgcggcgggcgcgtgggacctcgcggagctggagcgggaccacgcggccgcggcgccgtcgtcggggggccacgccgccaatgctgccgcggcgggcacggggacggagagccgcccgccggcgcccggggcagcaggggcacccgccgagtgctccgtggacctgaagctgggcgggatgggcgagtgcgagcccggcgcggcccgcagggagagggaggccgcggcgggggcggcgaagcggccgcgccccgccgggcccggcgggcagcagcagcagcagcagtgcccgtcgtgcgcggtggacgggtgcagggcggacctgggcaagtgccgcgactaccaccggcggcacaaggtgtgcgaggcgcactccaagacccccgtcgtcgtcgtcgccggccgcgagatgcgcttctgccagcagtgcagcaggtagtatccccgccttcttttcccatggggggctggtgtagtgtagtgtagctcgtccctgtctcgtttcaaggatgcacaactttaccttttccggcttgcctttttttttttcgttatcttttttctctctctctttttcctgaaaaccaaagagatgaaaaaccttcatctcgttcgttcgtttcctcctgtagctacggtacctgaattattggcacgcctttttcctttctcccggcctcctcctgcgctcgctgctgctgctgcacactgctctcaggcaggcctagcgttcgtttccttcactttctctgacgccctgatgcgaattaacatctgctgctccccaatcgtctgctcaagattcagcccgctgccacggacacgtgagctcctgcgcttgcttttccgagcggtttcttgctttcacgccctttggcggcgacgggacgggatgccccccccccccccccccccggtactctgccattggctcctcctctagtcggcgctgcttgcttcccggcgacagttcgccaccgccgcagatgaagcgccgccacggtttggcgtgccgcgttgagcgagacaggggtgtactcccagctttggctaccatcaatcatttgatgtttaggtgccgcgttgtgagctgtactgctacagtatctctgcagaatgtattctgtagtagtatgaaaaggtaaaggcggcgtactgctatagtatctctgcagaatgttcggaggagtacaccaactgaaagaggtttaggaaaattgcatcgtggatctagaattctagatgcagtagtgtagcctacagtagccctgtacacacataaaggcatttttcttataaaattgtctcgcaaaatgggatttttttgtgctaattatagggtgctttagcgccacctgggccgtataggatgctttagcgcaacatttctgaacaaccctatgcagcttccatagaccaccacaggcattcccgcatgcagtttgctctaaatgcctccttttcatttttactatccctgaacgacgacccatctcagggaagtagccattaaatgctagcagtctttttttaaagtatcgcttggtttgagatgttattaggcccggtttggttggaaaaaccgctccattttaatctcctttagtttgtaaattacagtactaaactgttttagtctttagtatctcgaggagtgactaaaagagactaaaccatataaatttcaccttttatctcccatttatttcagttacactaatgacgggagaatgctaaagtgtattttagtcatcttataattgatttagtgtgttttaaatacttccttagtctataaaattaaacaggatataggctaaactttagttggactaaaccatataaatttcgtctggtgaagtttacggcagtacagcgctgtgttggcgcccagttttgtcttgctcatatggacagcagagacaggtcccgctctcctgtggtggacctaaacctaaacagcgtaggttcagatcgttcctggagcgatcgacgctgtggcaagcgatcctaatgcgatgctctggtgacatgtcctgtttctgtttacgccggaacatcttgctcggtggggacaattctcaatcattgatcactttgtcttctgctttaaattgcagactttgtaggttaatagtaagttgtcagccagtgagccaacagattctcagctttctgtttaccgtctgtgtggtccaggcttgacaggtcttatagtattttcctgtctctaataagcatggacaaggaacattggtccctggtgtgatgtgtattaactataacaagcatgtatgtgcgccacagtacattaactattctgacaataattacgttgctgtttcttcagtgaggaccatcttagcataccgttggatcatgtgcccaccctactacctaggaccatctattcttctaaaaaaaactgagtatcttatacttgtttagaattatcctaattcaaagaatcctgtggtcctaatcgattatgccatcattcattggtcagcatattacactgcaactttctcgtttgcccgtactcgaattcagttgtctgatcaagagttttttttttgttttttgtttatgtaggttccatctacttgcggagttcgacgccgacaagcgcagctgcagaaagcgtctggacgggcacaatcgccgccgcaggaagccacagccagacaccatggcttctgctagctttatcgcaagccagcaaggtcattttcgtactcaccaattttgctttggttttttttctccccaagtctgtacttggttcgaatacatctacattgtttccatcttgctggtgctggacaaagaaaaggtaaaacgtcagaacagatctgtgcacacataaaccatgagaagtaaaagactgctctgttaaacttgtagagcttgcgtagcatttcagcatgtttcagaactagaattcggttcataagataagatgctactctagcatccctgcatacattagttgcgacaagacgaagattacattgttgacgcatcaagttattatgaacctcttctgtttctgtcaattgtgtcctcatatttagtgcaaggtcttgctaatgcctttaagttaaaaaagattagtatactgtatgtttctttgcctttcagatgtgttctagtacaaactacttgtatgcttcaccacttgtagattggcatgtatatgagtctcaaacttccaacacaattgccagcagattggcatatagaactgcaataaaaattctgattcacattgtatgaaacggcgcacagaatcaatttatcagttatgtcacctgatcgacatttcttcccaattgatcaggcacgcgattctcaccatttgcgcatccaagactggaggcgagctggccgccgggggtgatgaaaaccgaggagagtccatatcacatcactcaccaaatccctctgggctccagcagcagcagcaggcagcagcatttcgtggctctgggagccgccacgcctgcctacgccaaggaaggccggcgcttccctttcctgcaggagggcgagataagcttcgccaccggcgtggtgctggagccgccggcggcggctccagcgtgccagccgctcctcaggacgggagcaccatccgagagcagcggcgccggcggcagtaagatgttctccgatcaggggctggctcgcgtgctcgactcggactgtgctctctctcttctgtcagcgccggccaactcctccggcatcgacgtcagcaggatggtccgcccgactgaacacgtccccatggcccagcagcccgtggtcccgggcctgcagttcggcagcgcgtcgtggttcccgcgcccccaggcttccacgggcggctccttcgtcccctcctgccccgccgcggtggagggcgagcagcagctgaacgccgtgctgggccccaacgacagcgaggtgagcatgaactacggcgggatgttccacgtcggcggcggcagcggcggcggcgagggctcctcggacggcggcacctcgtcgtcgatgcccttctcgtggcagtagtcgtcgtcacttgtcagcagccgctgcgttctctcatctttcgcgcttcagacgatctggtagggagatactggctttagtgatcactgatcagcattgatttctgttctttttcctgcattcgctttgttgaatcggctctgctcgccagcattcgtgtggacattttttgaacataattctgtgttcgtttccctcacattatctttgctacggtgacacctgccggctgctgaccgtagcatgttccttctcttgtgacttgttctcgagacgtccatttgatgcagggcgcatccagaatttttcagttgcagtgcagacgcaatccgatgcgtttgaagatgacgggcatgtttggttcacggctaactgtgtcatacttcgactaaagttagtcgtccaaattgaagaactaactcaggcagaaaagttagataaaatgtggtaagttaggtagtaaaccaaacagacccgacaactgaggacttgttcggtttgaaggggtttaaggggattagaggggattcaatccccttctatacaaatttatatagaaggggattgaatcccctccaatcccctcaatccatccctaaccgaacagggcctgaacgggctcgccacatgtaggcatgaagaatagcttgctaaatctgctaaaaaagtaattgattggtaattcgtcctcattaccctagtaaaaaaggggacaaaatacgtaggtgccgcggcatcaggattgctggaggtagcagagcacagaacgtgatgagttcctgcaaggagtcgtgaatagcccctatctcgatctccgattctccacggtaaattcctccattagataatatcgatgagaaagtttttctccccacccacgagaatgtaaataaagaaaaaaattctccaccgacaattaaatgaggacgagaataaggaagcatttctaaccctgtttcttgcggggacccgttaaacttacatataatgatgtttttatataatagttaataataaaaataaataattatcttgtcaagagatcattcattataaatgtgctcattttgatgtaaacataatgattatcttacatctgacaatatgaagtgacaatgctttgcatcaataacaaaaaagtatgtcctaattataatttaagcgggggcggaaaatagggatgaggaagaaatacccag

SEQ ID NO: 586 - protein, 432 aa, Zea mays
MDWDLNAAGAWDLAELERDHAAAAPSSGGHAANAAAAGTGTESRPPAPGAAGAPAECSVDLKLGGMGECEPGAARREREAAAGAAKRPRPAGPGGQQQQQQCPSCAVDGCRADLGKCRDYHRRHKVCEAHSKTPVVVVAGREMRFCQQCSRFHLLAEFDADKRSCRKRLDGHNRRRRKPQPDTMASASFIASQQGTRFSPFAHPRLEASWPPGVMKTEESPYHITHQIPLGSSSSSRQQHFVALGAATPAYAKEGRRFPFLQEGEISFATGVVLEPPAAAPACQPLLRTGAPSESSGAGGSKMFSDQGLARVLDSDCALSLLSAPANSSGIDVSRMVRPTEHVPMAQQPVVPGLQFGSASWFPRPQASTGGSFVPSCPAAVEGEQQLNAVLGPNDSEVSMNYGGMFHVGGGSGGGEGSSDGGTSSSMPFSWQ

SEQ ID NO: 587 - DNA, 6485 bp, Zea mays
aagtttagctcaaattaccatcattagctctcctgtttagattataaatggctaaaagtagctaaaaaaaagctgctaaagtttatctcgcgagattgaaacatggccttagtagatgtttgttgcaaaaaagtgaagatgatagataaggtaaaaacatattttagtctcttttaggccccgtttcaatctgacgggataaactttagcttcctgctaaactttagctatatgagttgaagtgctaaagtttagtttcaattactaccattagctctcctgtttcgactacaaatggctaaaagtagctaaaaaaagctgctaaagtttatcttacgagattggaacatggcctaaagaactaaagtttagtcactctactttagggggtgtttggttagagggactaaagattagtctctagtttttagtcccttttagtcccttttttgccaaacactaggactaaaatatggactaaaatgatttagtctttagtccttcacataggtgctaaaagagactaaaagctcataattatcatgttgcccttacctttttatagataactaatattatgagtatattctaagggtatttgagtctttggacaatgtatttaatgactttagaatctatttagtcctaaaaccaaacatatagggactaaagtttagtcctaggactaaagtttagtcctagaactaattgaaaccaaacatgcccttagtcagcatgtttccttatttaggaactaaaagtgactaaactttagtcacctcaaataaaataggtctaaatctggaattattttcgtgtattctcgagacagaacgatttgatatgtgggtcagtgggtacaggcggcctgccagccgggcttctgccactgtaccgcggcgcggtgcgccaaagatggcatgcggctgagcggcctccgcctcgctcggctcgccgccacaagcgcaagtacctggcgtctacaaaaagccctcggcaggacgccagttgttgggacgggggacggggctataccaaccagccaaaaccaagcagggaatcacaccattcaccaagcagcagatggaagcgaaaggtggcgccgcggcgtggctagctaggccggctcgtgcgcacgcggagacagacacgggactggttgcgtgaccgagctctggtctggtggctggtgctgagagagagggagacagacgacctgcagctcgcatcacagtcccacagtgcaggagggagtggaagagagtagagagagagtgggagcgagagcacagggaggggagttgttttgaaggcaacagcgagccctgctgtccctctgcttcgccacctcctccctccctctctttccttcctcttggaggagagagaagagggggagagccagtcagccagccagcccaagaacagcgtacgtacgttgtcaagtcccgtcgccgccgcagcagcttcgctcctcccgccccgcccaccgtcgcgcgcggcggcggggagcgagcaatggaggccggcggcgccagcggcggcgacgacggggacggccagctgcacggcctcaagttcggcaagaagatctacttcgaggacgccggcggctccagtagcagcggcggcagtggcagtgccagcgcgaccgcgcctccagcgacgcagcagccgtcgccgccggccgcttcgcctagggccgcgcccggtggcggcaggaggggcagggccgcggctggcggcgcgggcccctccttgccgcccgcgcccccgcgctgcctggtcgacggctgcaacgccgacctcaccgacgccaagacctactactgccgccacaaggtgtgcgaaatgcactccaaggagccccgcgtcgtcgtcaacggtctcgagctacgcttctgccagcagtgcagcaggtcgccaccccgcccccgccattgctttctcattcagttacttcctttttcagtttgacagctagttgcatccgctctgcttcctgtgttttatttccgcttcttgtctagggtttatggaaacttggctaaaattaaacagttttaggttcactattatcgatgtacatcacatctatgggctatggcgatgacaattgttttttttttcctgacaccttctctttctggagaatgaaggatttttttttaaaaaaaacaaagatgagaacttgctttggtatcactactatactttaatgcttggtttgaatggtgctcatgagaactttaaagttggtaggtttgatgggtgctcctaaatatgatagagtgatgtgactcagccttgcctgcctgtctgtcagtttgttctgcattagattccagtgttaacttgcctgtcagttaacaagccattactatatggaatttgccttgagcttgatcggattgtgggtggtctggtccccaaaggaacaccactgaggaatttcaaaggagcctttgccgatgtggttgagtattaatctagagttccaactttacaagttgataatagtgctcattgcttagtctgcctcaaaaatagcactagacattatttgtcccctgtacttaaccaaactacatttggggtccttcacgaaaaaaaaaccctgcatttggcatgatcagttggccctcagtggtccccaaggaagaacaggcttgtctttgccactgtattattcttggtgttacaactttacaggttgtatgatactattcatattcaatgtttagtgcctaaaaaaacatgctcctctattttggctactaatacttaacaaactaaattaaattcattcggttctagatctggagaaaaaagtctagtcctttcaggtggtacaccgaacttaggttgtttctggaatagcttgtttcagtaggatacacttagcatattcattcagaaatttgctactgatgcctaatgatagcaagtgtatggaaagatcgagctgtctggtgcctaatgatagtaagcgtatgggaagatcgatctgtattgtgtcttagtaccagaacaatgcagcagagggaaaggaaagaaaaaagtagaatgtagttacgatcctacagacagctggttgtttcggtaatttggttctctgtaatttgacaatggtagcccgtaggattaaggcagtgtttagttaacttcaccgtatcatattctgtaatatatagtttcaatttttgttaggttcgatccaagcttttggttttctttgtcgataaattagttacaacagaaaaacaaaacaaaacaaaacatgatatataatggaagtgtggaactacatgtcttaaacatcgatatgcgtaggggtaggacctgggcacaccaccctatcgaccacaccttttgtgctttgggactaggctaaaggggtgtcctaacgtccccagcaaagaaaaggtgccacacttctggatttgggctgtactaaaccacagcaccacatagccacaagccacttatagcaacaacacatcattagagaagctaagttggaccatccacctgctttgctgttaaggacacctggcttgacattgcatggaaatctcattggtggatgtgcattgttgtgttaggcccggcatctcacatctctgtgaatgattacatgcactctctttgctttcttttagtatggatgtgcaggtgtaattatgagtggcataagacagaggttaatcttttaatggatgttcagtactggcctagcctagtaggaagagaaatgttactcttgagggcttgttcgttttgctctcaatccatgtggattgggtgagattgagtggatttaaatcctaaacaagtgaaaatctttcataatttttttcaatcccattcaatccacatgggataggaataaccgaacaagcccgaatgtatagcattcccactggctttgacctaaagtatggttttttatatctatgtcgcactatgcatgttgctactaagataagttgcgctattaaggtaaactagcactttgaacttactattatcccatcattcaacttgcatttcattctattgtaagtgttattatggttgatgcttgatccatgaatttaatacttcctgcttcgtttgcattatacacaaaagttatcaatctacatcaataatatatgtggatttggagaatgcaactagcttgtattcctcataaaaccctgttactgtgcctcctcgcctgtaagttgaatcaaggacgcttgagtgaccacatctctctgtccacactgatcacaggttccacaacctggccgaatttgaccagcaaaagaaaagctgtcgcaagcgtctagcaggccacaacgaacgccggagacggccacctcctggaccccttgcgtcacgatatggccgtctcgctgcaccgctcggtggtacaaaaaagctgcttcatttctttctacttggtgacttgggtgaccaaagtttcagttttttcgtatctgttgctaatgttcctacacttgatccagaagagcccggcggcaggttcagaagcttcatgctggatttctcatacccaagggttccaagcgccatgagggatgggtttccagcggttcgacctggtggtgaaagggtgcctggcagcaatatccagtggcaagcagcgagcctagatcctcctccccctcaccatcagagcgcggcagcaggatacggtgcccactcgtacgggagcccgggtagctcgtcgtcgtcgaggccaccggtgttccctgctggcccggagctccccccaggcggtggatgtctcgcaggagtccccacggactctagctgtgctctctctcttctgtcaactcagccatgggacgctgctggccacagcgccggccacggccacggccacgccgcgtcactgcccgcaacagcaggcttcgacggcaaccccgtggccatggcgagtagctacatcgcgccgccaagcccctggaccgactcccgggcccacgaaggcgggcggcggaacgtgcctcaactgccacccgacgtccccctcggcgacgtgcactctggcccaggcacccatcacggccagttctcaggtgagctcgagcttgccctgcagggaaacaggccagccccggcgccgcgcaatggccagggctccgcgggcgcgttcgaccaggccggcagcacgacggagtggtcgctctaggaggccaaataaaagcgcggcacatcgtcgtagccgcacagcgagatggagcttgaagcctggctccgctagctacctgcatgcgctgtttgcttgcctagaggctagagcatccagtatgataataagcgaggaactagtgcagtgccggccaggagactgatttcttttgcgcttgtccatgaactcgtctgttgcgtctatgtacacctccatggtttgaactcgtcggggacttcgctcgatgtgttattaatctcatgctcatccttccgctaatgttgcctggcggcatcgccaggaatcggttccaaggcagcgttgttcatgtaaagcgagaccgcaggctttgcagcgtgctctcagcaccagtggtgtgggtgccgatagacaggctgactgacggagggcagaatgagatccatcgtccatgcagcagagcagcttcctccaaatctacagaaattttctcagtggatgagaacaaacagcggcacctttcctgtgaaaaaagagattttattgtttccttcctcctgtctcgaatcacagcttgtcgtgcagctagctgttccgatctctctcgctcgttttcgtccagtccctccctgttcgctgatcgagcaggcgtttgcggttttctccccagtgagtagagacagcgagtgttctggatctgtcgtacaggtcggggactgtagctgccggtgcacagcgtgcgtgattcagggccccgcccaaacagactgaggaacccacacactagaacaccaatgaaagctgcatcagtctcagatgcggcagcctgtagactacgtagatccttggacgatgaacagcgaccgcgatgcacggtacagagatcctatcaccgcactgtagatgctcgaggaagtagctagctagggctggggcgttcacgagtgccagctgatacagacccgaggacgaggagtgtaagatgtttccgttggagaatccactcactcagttttttttcttagtagcatgtaaatgcaacagctgaagttgaagaaaagtacccgattttacagactgaaactttgagagtttgcacaccctctcgagcattacacacctccattggaaaatcccatcctgaagccaccgtcgtctcctctcggagagtggcggcgcttgttgctgggccgaaatgtatgttaaggccggcccatgtggtggtttatggggaggatccacttccgacggggggttcggccttgctggtcgcatcgggatgggttggtccagctacgag

SEQ ID NO: 588 - protein, 408 aa, Zea mays
MEAGGASGGDDGDGQLHGLKFGKKIYFEDAGGSSSSGGSGSASATAPPATQQPSPPAASPRAAPGGGRRGRAAAGGAGPSLPPAPPRCLVDGCNADLTDAKTYYCRHKVCEMHSKEPRVVVNGLELRFCQQCSRFHNLAEFDQQKKSCRKRLAGHNERRRRPPPGPLASRYGRLAAPLGEEPGGRFRSFMLDFSYPRVPSAMRDGFPAVRPGGERVPGSNIQWQAASLDPPPPHHQSAAAGYGAHSYGSPGSSSSSRPPVFPAGPELPPGGGCLAGVPTDSSCALSLLSTQPWDAAGHSAGHGHGHAASLPATAGFDGNPVAMASSYIAPPSPWTDSRAHEGGRRNVPQLPPDVPLGDVHSGPGTHHGQFSGELELALQGNRPAPAPRNGQGSAGAFDQAGSTTEWSL

SEQ ID NO: 589 - DNA, 4664 bp, Zea mays
aactaaaaatgtaatagtgcgtagttggtatcaagtatcatagctattgatattctattatatattttttgttaaatctaaattattttgttttttcaaaaaacgataaagtaatttattaggatagaaagaaaagtttctataaatttgatttagggggtgtttggttacattccgctaaaatttagcccctgtcccatcgaatgtttaaacctccgttccgggtattaaatgtagtcggattataaaactaatttgtcagccgaagattaaaagacaagacgaatctagtccagttggttgggtttatatttcatactcctaattaaaagtcaaacgcttgatgtgacccaggctaaactttagcaggagcaaccaaacatctcttagtagtttagaaaagcttgacttgattcaaatataaactataagtttataataaggaacgggagattctcgtgaccgtgtctcgactctctcacgtgtcaccctgctccgccttttgtctctgctcacgtaccagtatcccagtcaaagcgaggcggtacccccctaaaacgtagggtcggacaacaatatggctaccagccgaacactggcggtctggcgcacaccatcacatctaaccattacacagtacgcacgctcccaggctcccgccagtcacagaggcccactctccgggtcctcgagcgaagcatttgcattgccagccccgggactcggccggcgcacacgtaaccacgcgcgcgctgctctgtgctctctgttgctgccacccttcctctgcgttcctccgactgaatgatggactgaatgatggattggacgtgcgcgctgatggatgagcaggcctgacaccaaaattgacgcgccctgatcgtatctttccatcgatctcttcctcctcgctactctacgtactagtagactagaaggctgtgtagtagggctctgatcctattatcttcatcaaatttgcgcggcgtctgcgttccctgcttcccattcgaaaacaaaagcaaaaggtgcgcattcacggtgtcgccctcgtctctactcgtgtctcgtcttgggtagcgtacgcaccttagctcgcaaccatccatccatccacggggctcgggcgcagcagcctcccccgtcgtcgtcttcgtcgtcgccttgccgccgctctgatccgtgcccgatgcatcgtcagccatctcctcacgccttcaggtagtaaaagtatactaagccgcagggcaccacaacgcaacacgtggtgcctgcctgcctccttccttgttcgctttgcggcgcgagcgttttgtctgttgttgtctcccttgggaccggcgcgtccggctggctcactaccactaacgtgttgttgcctgccttgtgcggcgcccgtggttcgcattgcgtttgcagcagcagcggcagctgggcggagcagggcgcgggcgggtaccgccacggcagggacggcgccaccttcctcctccccgagctcctccagcgcagtaataacgccgccctgccccttgtttatccgcctgcctgcgtattttgtttcctttctttttcttcttgttggatttctcatggctgttggttgcacgcgcgcgcatcgcgggggctaatgtgaaggccccaaccccagctccaagtcctccagcgccgccaccttcgtgccgccgctcgccgccgcggtgagttcactgactgagaatgagatacggttcgttctccgccgcggcttcttcactttgagcgtgaatgacatggaggctctctctggcgtctttttgtctgcagcatggaggaggagtagcggccccgtttggcatggcgccgctgggagtggcggcggcggacgaagcccggttctgcatgacgccgtggtcagcggcggcgcacttcgagaactggggcgactccggcatcgtcgtcaccagcccgctcgccgagacggcctccaccgacgtcgacatggtctgctcctcaatactcagcttccatccatcttcatccgcatgcacagtatatatgcctgccatgaactccgcctggagtatatgtatatgccgtgacgtgtgactccaccgccgtcgtcgtagggtggaggtggagccatggcgcagagcgtcgacggacatgacaactcattgccggcgtgcaaggtggagcccagggatcacaaggtgcgctatgccatgtcacgtgaacacgtcgtcgtggtcccaaaaaggaactagaagagcagcagatgtgattgtggtttttgtgctgtgtcatggcaggcgcagaggaggcttgcgcaaaaccgcgaggcggcccggaaaagccggatgaggaagaaggtgatcccccttcccctcacgggaagcttctgtacattatgctatgcttgcaagttgcattccatcctgtcttcttcttgctcagtacccccctgtttatttaccctgacgggaggcttactgagttttgtctacagttttactgtaccatgctgtcactgtttccacttgcaagatcgctgaagcactgtgcaaattcgctctgtaggcgtacattgtggagctggaaaacagccggtccaagctgtcccatcttgagcaggagcttcaaagggcaaggcagcaggtgaactcctgatctgttttcctctgaagaacgaaacgatccatactacttcgacgctgattgtctatgggctgtaaatacaggggatgttcattgcaagtggacgctccggagatcatggatgctccactggaggcagatgatctttttttcttctcttttacattgctcagctcttgttctctgaattctgatcctgtgcaatgtaaagcctaacctgtgtccttgcaggtgcgttggcgttcgacctggagtacgcgcggtggctggacgagcaccagcaccacatgaacgacctccgggtggccctgagcgcgcagatcggcgacgacgacctgggcgtgctggtggacggcgcgatgctgcactacgaccagatgttccggctcaagggcgtggccacgaggacggacgtgttccacgtgctgtcgggcatgtggatgagccccgcggagcggttcttcatgtggctgggcgggttccggtcgtcggagctgctcaaggtgctggcgcggcacgtggagccgctgacggagcagcagctggtgggcatctgcggcctgcagcagtcgctgcagcaggccgaggacgcgctgtcgcaggggatggaggccctgcagcaggccctcggggacacgctcgccgccgccgccacgccgtgcgccgccgacagcgtcaccaactacatgggccagatggccgtcgccatgagcaagctcgccaccgtggagaacttcctccgccaggcggacctgctgcggcagcagacgctgaagcaggtgcgccggatcctgaccacgcgccaagccgcgcgcgcgctgctcgtcatcagtgactacttctcgcggctccgtgcgctcagctccctgtggctgacgcggccgacggattgattcggcgtaggcacacggacgggagctgtcgttggttggttgcgctgagactgtaatctgtatccgttgtgagatggggtgaccatgcggattcatcaggcagaaacggcgaatgtgtctagctttagttttggctaccattcagcttcatcagtgaggctagagtagagcgatttcggtgcgcatgtccaggcttttgctccgcgttcattgtctcggctgcaattgcctgcggtctgcagattccctcgtcatgggctcatgcccagctgcgcgccggccgcgtgccgtggaatgacggaatgaggaagctgggtccgcggcaatcatgcgccttgcccgcctagcgtgtcgactgcatgcagtcctgcggggacctgatcgcgtggctaccgatcactactgcactgacactggataccgtgggtgcatagatgtgcaaaaggactcggtactggctaacaagggggtgtttggttacccctgctaaagtttagctcgggtcacattaagtgtttgacttttaaataagagtataaaatatagacccaactaactgaactaaatttgtctcgtcttttaatcttcggctgacaaattagttttataatccgactacatttaatacccgaatcggaggttcaaacattcgatgagacaggggctaaattttagcggtttgtaaccaaacaccccctaaggctgtgtccaacaactaacgctataacgaactatacgttaaatatagcgttgttgtgtccaacgagtaacgctataacgtcatatagcgttctccgctcgctcgcccacacgcgtccagcaatgtgaatcaatacgacataaagtagattaaacacagaagacatatttagcatgaaaaacccctccaaagcgaaggagaaaaaaccacggacaccgacctacaacaatatcactatttttcgggttgttacagatcacaagagatttacaatgaggtgacgatctcttgcggattataagtgtatttatagagacgaaaccctaaggtgagtagagaacactccggcccaagcctcccgacgacgggcctccgcttcgctcgccaacttggccgcattcttcagaattttgatcacaaactcaacaaacgat

SEQ ID NO: 590 - protein, 432 aa, Zea mays
MHRQPSPHAFSSSGSWAEQGAGGYRHGRDGATFLLPELLQRSPNPSSKSSSAATFVPPLAAAHGGGVAAPFGMAPLGVAAADEARFCMTPWSAAAHFENWGDSGIVVTSPLAETASTDVDMGGGGAMAQSVDGHDNSLPACKVEPRDHKAQRRLAQNREAARKSRMRKKAYIVELENSRSKLSHLEQELQRARQQGMFIASGRSGDHGCSTGGALAFDLEYARWLDEHQHHMNDLRVALSAQIGDDDLGVLVDGAMLHYDQMFRLKGVATRTDVFHVLSGMWMSPAERFFMWLGGFRSSELLKVLARHVEPLTEQQLVGICGLQQSLQQAEDALSQGMEALQQALGDTLAAAATPCAADSVTNYMGQMAVAMSKLATVENFLRQADLLRQQTLKQVRRILTTRQAARALLVISDYFSRLRALSSLWLTRPTD

SEQ ID NO: 591 - DNA, 3338 bp, Zea mays
aaataatgtcgtactgtatacactcgagatttccatcgcacaagacacgaaaaaatcccgatcaatttaacgaacattgttttgcattatagattatattgtttacagaatgaagttaactaaaaccttaaccttttgcagataaatctctaaatagtgccgtactgtatacactcgagatttccaccgcacaagacatgagaaaattccggtcgatttgacaaagactgggtgttattaattagaggaagcagatccagccacatgttgtctcacatctgatcccccacgtatagtcgtatacgtttggcccaaacctagctcgatccatgtatgaaacacgtctcgtctcgccttctacctcctttttctatcacaggagattaaagtgagagagagagggcgctcaatgaactgcggcattgaacaatggagctgcaagagcaatgatgcactagctagtgtaatgcagtgcatgcatggtagattggtagcttgcctttgcagtttgcaccaggcaccagcagcagctagaagacgacagacgacaggggtttggctgctaggttgcggaagggcagttaccagttgccacaaggggagcctggccctctgcatcctcctcatgatagctctgtctctctctctcacagacacacacacagagactcttccaaattccgaagcggccaatgcaatgcaagagccagcccccggccgtgtgtcaacttcacttgtctctctccaaaagatatcgtatcacccatggccatgacccccctcccccagccccaacctatatcacctagcgcagctacgctctcttctcccgctctcgctctctgcatgctagctaccttctagctatctagcctctaggtccaatgcactccctccttataaacaaggaaccctccttcgcctctcttgccatagaccggacaccggagaggtcactgcacaggagcgctcaggaaggccgctgcgctgagatagaggcatggcggccaatgcgggcggcggtggagcgggaggaggcagcggcagcggcagcgtggctgcgccggcggtgtgccgccccagcggctcgcggtggacgccgacgccggagcagatcaggatgctgaaggagctctactacggctgcggcatccggtcgcccagctcggagcagatccagcgcatcaccgccatgctgcggcagcacggcaagatcgagggcaagaacgtcttctactggttccagaaccacaaggcccgcgagcgccagaagcgccgcctcaccagcctcgacgtcaacgtgcccgccgccggcgcggccgacgccaccaccagccaactcggcgtcctctcgctgtcgtcgccgccttcaggtatgtgcgtcagtgcgtgtggtgtgggtagtatatatatatatatatatatatatatatatatatatatatatatatatatatatatggcctctctttgcattggcacgccaatcggccatcgagatccaatcatatatatcatccaaacgtatagtattagtacatctgtacatgtgactgcaaactgacgtgcacgcgtgtgcaccgtcgtcatcactgatcaggcgcggcgcctccctcgcccaccctcggcttctacgccgccggcaatggcggcggatcggctgggctgctggacacgagttccgactggggcagcagcggcgctgccatggccaccgagacatgcttcctgcaggtgctgtagtacgttcttttcttggggattgcgcgcagtttcacgtacgtacgtacgttcgagtcgatcgccgcgtcgttccatccaccggccggtatatataactgttgggtacggcggtgcgcgcccgcaggactacatgggcgtgacggacacgggcagctcgtcgcagtggccatgcttctcgtcgtcggacacgataatggcggcggcggcggccgcggcgcgggtggcgacgacgcgggcgcccgagacactccctctcttcccgacctgcggcgacgacgacgacgacgacagccagcccccgccgcggccgcggcacgcagtcccagtcccggcaggcgagaccatccgcggcggcggcggcagcagcagcagctacttgccgttctggggtgccggtgccgcgtccacaactgccggcgccacttcttccgttgcgatccagcagcaacaccagctgcaggagcagtacagcttttacagcaacagcacccagctggccggcaccggcagccaagacgtatcggcttcagcggccgccctggagctgagcctcagctcatggtgctccccttaccctgctgcagggagcatgtgagagcaacgcgagctaccactgggacgtgcgttgctgtcattgtcctaggttagtagctagtgccagttactagtaagcatcaggcataggagtatgtagtagaagcatgtctggagaaaggcaatagctagcgtttgggagatctctggcggtactattattagatagcgaatttgcatactatgcagcatgcatgttgccggccgggcgggctttagactccagctactgcatgcgtgcatgcggtggtcctcatgtatgtcggcatgtgtgcgtgtgtgtgtggcagcagcagcagcagtgaattctagtgcagtggtggtggttgtaacgtgtagtttgggggcaggggcacagttgtgtcgaacttgtgcggttgtcccttccttttgtgacttccagaaaagggaatgaggcctgcctgcgtgtctgcttttccatgctcacctcgcctgttgtctgttgagacttcactcagccctgttggtgccttgtagttccagttccagagcatatgcaggtgcaggaatggcatctctaccactgctttcgacttgttggcttgttttcttctatgatactagtgtacttggattgaatgatcacattttttgctggcctcgtatctttgaaatgatcatgttaatttggttacacataagacgataagggtaggtagttcaatgctattagaaaactaggtatttttagttatattttaatccaggaaaaaatatataaaaactaatcgtgatatatagaaatacgcatatgcaaacttagtataataattatgaatacaatagatagtaacctgattgtatatacttttaagggaaaatagatatggcaatgggcctcgatcttcgattctctgcggagaattcttccattaaaggatagggatgaggaaacttcgtccccccacggagatgtaaacgagaaaattttctaccccgatgggtaaaaccagagatggggtgaggaaacatttcccata

SEQ ID NO: 592 - protein, 325 aa, Zea mays
MAANAGGGGAGGGSGSGSVAAPAVCRPSGSRWTPTPEQIRMLKELYYGCGIRSPSSEQIQRITAMLRQHGKIEGKNVFYWFQNHKARERQKRRLTSLDVNVPAAGAADATTSQLGVLSLSSPPSGAAPPSPTLGFYAAGNGGGSAGLLDTSSDWGSSGAAMATETCFLQDYMGVTDTGSSSQWPCFSSSDTIMAAAAAAARVATTRAPETLPLFPTCGDDDDDDSQPPPRPRHAVPVPAGETIRGGGGSSSSYLPFWGAGAASTTAGATSSVAIQQQHQLQEQYSFYSNSTQLAGTGSQDVSASAAALELSLSSWCSPYPAAGSM

SEQ ID NO: 593 - DNA, 6593 bp, Zea mays
ctgctgctgctgatgcttcttcttcttccaccgattgattgagatccaaggaaatgctgggcgcgtttttaaactggctgatcggcttcgtcccatgatctgagatttccttttcagactgttgtatatgtagcggcgacatggataggatatgtatggaccgttttaattaatactaaatatcaatggtttaactcttcactattactcctagctagatgtgaaagctcgccctggaatgcacatgaacaactacaccgagttgggcagtttggcaatgcatgcagttcaagagccacgccggttaacccttcactttgtagttattgcctgcattttgtaaatttggtgtgaacttaattctaatctgtaattctgtatagagaatggtgcatgtactgaactcctgactgatcaaaacgtggggtccactttcctcgccgaaaaagaaaagagaaaaaaaggtttattgtccactttattaaaaactggacttatatatatgcttggaacaaatacttagggggtgtttggttttaggaatctctcaatctaaaataaggtggtgtatcataggtttattactcaaatttggtgggatgatctcattgctcatattagtactaactaactaactatgaggaatgagatggtgatggatcaacccattacattctacaaaccaaacaaaaaagtgaggagtgagaagatggtgaactagctcatttctcaaaccaaacactctattaataaaccaatcgcgtagctaataaatatatgtaacctcgacattctagctacagcttgtggttggtagaaaagcaaatcatgctcaaaataatgtgctccgaaacttcattacatttttcttcacttgagtgtacatacattttttttcccttggccctcttatccttaactaagaagcataaaacgggatttctcagccagttcttagcttctcttataaatacagaccttgtacaacactttcacctcctctcaggtggccaggatattttttctggccccttcctgccctcttcacactgacccatgtgttgttctatccctggaaagctatacctccttacccctatcagcttctcctcacatctcctctcgtcgccacccatgctatcaccgctctgatcacaagcaaggcaaaccctcactgttctatcaacgcccctcccttagctagatggcttcagcgaacaactggctgggcttctcgctctcgggccaggataacccgcagcctaaccaggacagctcgcctgccgccggtatcgacatctccggcgccagcgacttctatggcctgcccacgcagcagggctccgacgggcatctcggcgtgccgggcctgcgggacgatcacgcttcttatggtatcatggaggcctacaacagggttcctcaagaaacccaaggtgaggagcagaggctgcaactagccaactaacaatctctttggtctgattgatcgatgacctctcttgctagtttttctatcgtatggtgcactgcacgcgatattctatggggtttttttacggtttgtttcttgatatttgatgtgggtgctctcagattggaacatgaggggcttggactacaacggcggtggctcggagctctcgatgcttgtggggtccagcggcggcggcgggggcaacggcaagagggccgtggaagacagcgagcccaagctcgaagatttcctcggcggcaactcgttcgtctccgatcaagatcagtccggcggttacctgttctctggagtcccgatagccagcagcgccaatagcaacagcgggagcaacaccatggagctctccatgatcaagacctggctacggaacaaccaggtggcccagccccagccgccagctccacatcagccgcagcctgaggaaatgagcaccgacgccagcggcagcagctttggatgctcggattcgatgggaaggaacagcatggtggcggctggtgggagctcgcagagcctggcgctctcgatgagcacgggctcgcacctgcccatggttgtgcccagcggcgccgccagcggagcggcctcggagagcacatcgtcggagaacaagcgagcgagcggtgccatggattcgcccggcagcgcggtagaagccgtaccgaggaagtccatcgacacgttcgggcaaaggacctctatatatcgaggtgtaacaaggttagaactttgattagtttgtgtcttcgataccttttgttattgttcttcgtttcgtttcaaattggtccagtgaggtataactatattcagagaacataactttagcatgaccttgttctagtactactcgagcaaaataccatggccttgttgagcgatcaatccatggagaacataaaccatcagatctatgctagctaatgcaactttggagacagtagccatgctatttttcttcaatttttctctagtagttcatttatatatgatacttagaagataaggtgactagttctgaagtataccatttgtgtactaacaagtggatgcaatatactgatctatttttcaatatgtgctgcgatgacggcaacgtatgccactgatcacttaggtggttgagaacggagtatatatatatgcatgtacaatttgaaatggtactccttgtgtggactgttatagttgcttttattctatttgcaagggaacattggaagctatatacacatatgcaagcgtatttttgcttagtttttggataattaccatatatatatatatatatatatatatatatatatatatatatatatatatatatatatatatatatatatatatatatatatatatatacgtgttgaggttggtaataacaaatgtttttgaaaacgcactatatatatgcataattttgagtattcttgtttacaggcatagatggacagggcggtatgaggctcatctatgggataatagttgtagaagggaagggcagagtcgcaagggtaggcaaggtaatgaaacatatatccataacaaccactgcttatatcgtcatagaaaaaacatatatggtttgtacaacttgagctactgataaagtattgtgtcttttggttccattgcacacaccctggcttcaaacattgcctaccggaatgacaccaacaatatgcagtttaccttggtatgcattcaccttagctcctgcccttacatttttgttgttgtatagatcttcctattttaacaatcattttgctatgccattgtatatccactgtatacacttaggtggctatgacaaggaggacaaggcagcaagggcttacgatttggcagctctcaagtattggggcactacgacaacaacaaatttccctgtacgcaaagttctatatggtgtttctttgggtgcttataacagaagcattttgacttgttttttaaacactatatatattaatctttgttcttgaatttatttttttgccaaaatttcattgttgcagataagcaactacgaaaaagagctagaagaaatgaaacatatgactagacaggagtacattgcatacctaagaaggtattattttgatgcttgtgtccttgtcattggttcacttccatgaatgatttgactaacagttaatatgatcttatacattcagaaatagcagtggattttctcgtggggcatcaaagtatcgtggagtaactaggtaattaaacttcactagtaggcaatgtatgatttgtgtgcatacaaaaaaattgtccttttatttcacattatcattagatgcctgttgtgggaaaaacataactttacaagagatttatggaacttgtttttgtttcctttttttatattgacatcaatgttgttaatcgatcagacatcatcagcatgggagatggcaagcaaggatagggagagttgcaggaaacaaggatctttacttgggcacattcagtaagctagctagctgccttcttttcttgtttgattgttttgagaactcagtgaagctagcacccattgattagtgattaatgcaactcataaaaactaattgctcggttaatggagatccttaggttagttaatgactactcatagtgttatatatgtccccaagatctaagtcatctcgccccgccgtacttgtttagtcaaatttcttgaaatcttcgtctcgtagaactgaagattagatattctatatgttgccctatgggagcataaaatagtgactacaccattaactatgtcccaaatgtacctttccaagtttttgtctcaaagttgtctgagaaaatcggggcatgcggtcaaaggggtcgagcagaaaaccctagtgctttgaatggcacagtgtgcacccggcctgctgcatgcatgcaatatcgtcgtgcattggggaacgacaaccctaatcatgcaccctgtgctgtgaagctaatcgtcgtgcacattccctcgtacgtaggcaccgaggaggaggcggcggaggcctacgacatcgccgcgatcaagttccgcggtctcaacgccgtcaccaacttcgacatgagccgctacgacgtgaagagcatcctcgagagcagcacactgcctgtcggcggtgcggccaggcgcctcaaggacgccgtggaccacgtggaggccggcgccaccatctggcgcgccgacatggacggcgccgtgatctcccagctggccgaagccgggatgggcggctacgcctcgtacggccaccacggctggccgaccatcgcgttccagcagccgtcgccgctctccgtccactacccgtacggccagccgtcccgcgggtggtgcaaacccgagcaggacgcggccgccgccgcggcgcacagcctgcaggacctccagcagctgcacctcggcagcgcggcccacaacttcttccaggcgtcgtcgagctccacagtctacaacggcggcgccggcgccagtggtgggtaccagggcctcggtggtggcagctctttcctcatgccgtcgagcactgtcgtggcggcggccgaccaggggcacagcagcacggccaaccaggggagcacgtgcagctacggggacgaccaccaggaggggaagctcatcggttacgacgccgccatggtggcgaccgcagctggtggagacccgtacgctgcggcgaggaacgggtaccagttctcgcagggctcgggatccacggtgagcatcgcgagggcgaacgggtacgctaacaactggagctctcctttcaacaacggcatggggtgacgacgacggtacggtccaacgaacggagagggcagaagctagtggctagtgatagggggttagctagctagaagatcccaagtctaggttagagttatttggtcatcgttgtcgtgtttcgacgtgctcaggttctggttcgattctgcacaattaacccgtgcatgcacgcgtgtgcctttctggaagctggtaatggcaggtcagggtaagtaaagttagtgttgtaagttatcctgatgtgctgttaattttgggtagtttcagaaggtctagccaatctcttcggaggactcaattgtcatcttgcttgcactcgtgcttatgagaataactttatcatatttcatttttctgatcacgaagttacttttattcttctagtactactgtgttcgtcgtctgtagttatatatatcatcgttgacatttctacaccataattcttaagagatatcaactccgtactgttgccctgctgattagctaccgaaattgtgaccgcgagaaaagacaagcgagataaccgatcgagtgctaataaagcattactagctacaacaagaaggaactgaagcaaagtcaagctagggacagatcgagaacataaaatcaaccggaccaatctaagggggtgtttgtttgggattataatccacctagattatataatccaacaatttttgaactaactattagttcaaaagttgttagattatataatctggatagattataatctcaaacaaacaccccctaagcaacaacattgtctggaatagctaatctgtcgccactctccgcacgtacatttcattgaaggaagcttaacttctactaagcttgccatcaccgcatgcgcgcatgccaccgtgaagggaggcatgcacccacctctgccgcacctatgccagggtcgtagtcgacaaagaggtcgtttacgatggcgtattggcgtgttacattgatcaattctaggcggttgggccccaattgaacctatcgatttacatatatttgcggcttccatgtagctagatcatatgtttgttctaaggcaaactatttaaattttgaccaacaatatatacaagattaaattgttttaaactaaaagaatatatattataatagctcgtcataatgaatctagtaattttccatttatgttgtaaaatcatataaaacatctggtataatcggtcaaaaatgacaatgatcgacttaagacaaacctaaaaataaaaactcgcgtggccgcaggtagtacttattagttgtttaatgagc

SEQ ID NO: 594 - protein, 679 aa, Zea mays
MASANNWLGFSLSGQDNPQPNQDSSPAAGIDISGASDFYGLPTQQGSDGHLGVPGLRDDHASYGIMEAYNRVPQETQDWNMRGLDYNGGGSELSMLVGSSGGGGGNGKRAVEDSEPKLEDFLGGNSFVSDQDQSGGYLFSGVPIASSANSNSGSNTMELSMIKTWLRNNQVAQPQPPAPHQPQPEEMSTDASGSSFGCSDSMGRNSMVAAGGSSQSLALSMSTGSHLPMVVPSGAASGAASESTSSENKRASGAMDSPGSAVEAVPRKSIDTFGQRTSIYRGVTRHRWTGRYEAHLWDNSCRREGQSRKGRQVYLGGYDKEDKAARAYDLAALKYWGTTTTTNFPISNYEKELEEMKHMTRQEYIAYLRRNSSGFSRGASKYRGVTRHHQHGRWQARIGRVAGNKDLYLGTFSTEEEAAEAYDIAAIKFRGLNAVTNFDMSRYDVKSILESSTLPVGGAARRLKDAVDHVEAGATIWRADMDGAVISQLAEAGMGGYASYGHHGWPTIAFQQPSPLSVHYPYGQPSRGWCKPEQDAAAAAAHSLQDLQQLHLGSAAHNFFQASSSSTVYNGGAGASGGYQGLGGGSSFLMPSSTVVAAADQGHSSTANQGSTCSYGDDHQEGKLIGYDAAMVATAAGGDPYAAARNGYQFSQGSGSTVSIARANGYANNWSSPFNNGMG

SEQ ID NO: 595 - DNA, 5514 bp, Zea mays
cgacttcgattagtatatacctgcatgaggcatgttcaggatgtagctataggtgagagtagtagcaacacgtagatgagttagacatatgtgcttttagagattcaagtgctaatgtgttagtgtcatagttagttatccgtacgagtaaataaacatgttgtaatggacaaatcatgtggtaatttctaattaggtgctaattagtatgtatgtttttcttttttttcattttctactatcttagaatcagtctatccaaacacctaaattctaaccaccagcttcttcccatagcacctaaaccaaatactcagattcttcttcttcatagtcagattctctctacaaccattttttcaaaaaagctgaatcaaacagactcatagacacacgatgttcttgtctatttttatctttagtactagtttgacaattctatttaaaaaaaactattttctcgagataaattagctggaaatctcttagactaactccaacagagcagccaaagccaatatggctgtcgtggtgctactgtagcgcctagaaacaggttccaacaacacagccaaaaggagcagctattttagaggggatgagagagaaaagctagattggctggttcagagccggcagccattttctccccttcgtctctgacaatccggacccacttctgaggcttctggccactcgccctgggaaccagctattttagctgctccgttggatacgaaggacgtatggatggccagctaaattactgtggcaagccaacggcctgaatgtctgcccgttttggctagtgcctgttggagacagccttaggagttgacaaactaggggctagtttggatcggcacgccggcggccacgccgcgccacacctgtggcgctgaaaacgagcgccacactggtggcgtgggaagtgtggcgggcggcggcggcttaggcggccatccaaacatcccctagaccttaaccaaacattcctcccttctcgcttgtgtgtaacacccactccgtatttttcaccagcgccaccacggtaaagtgcacgctgttcctgcgggacattactacaaaaccaatcccccgtcttgcgaggtcgcgagtctctccaactccgtccctctggcctcagcacaacgccagaccgcctgcctgtgcttgcagccaggccggccagctgcctgcctgcctgttgtcgtctgcggcgcgacggcggccgcccggtcgaccgcccgcattgggatccccagagcagcgcttggcataggggaatgtcccgggtcagccaccgtcgcctctgcgctgcgaaagccccgcatttacttgccacctagaagggggcacccctcgcgagacccagcgccagacagagccagcaatggctgctgctgctgctcctcctcctcctatatagcggggcccgtgccgagcgctcgatccagttcttctgatctctgacttctgagcgaggagtggacgagtggtgtgccgtcgtccggttcccgttggtttggcgatgaggcgcgctcgcggtcgccgcgggctgctgcttctcctcggcgtggcgctctcggcggctgcgctgctccgtggctgcgcggggcagcaaggggaggacggctcggacgcccctgcggcggcggcggcggagacggcccccatggaggagaaggagcgcagggcgctgtacgccgccatcgagagcttcgtcggcaaggggtggaacggctccgggctctacccagacccctgcggctggtctcccatccaggcgcgtccctgcccttcctgcgctttccctttcgcatcgatctatgttaccgtgctgttcgattttctggcccgcgtatgttcgttcatcatgttcgttcttcagacgcgcgaagctttcctctttggttttttcggctttgcccgtcctcgtcacacgccctttctcggtgctcccctgctgcctgctttgagctccaatccaaaaaccgtttgcgagcgaaaggaggagcaagtcggtagcctccgaaatgaaattggtgccctgtttggggatgcaggacgcacgccaagtcgccaccaaatctcctgctgtaatttcccgtgttaaaaccttcctcgtctcgcttccagaatttctggccttccggtagcctctgctgtttttgtcttgtgttcgtccttcgtcgcactcgtgccctgctcctcaactgttgcttcgagattgtggcactgttttgctgtgcgccgctgcacattcagttcactgttggacgagacctctgcttgatccccttgtgtcttcgcatctcagccttttgctcgatatggtaggaggatctgatctcttgggcaggaactttccactcacatgaaaagaacctcccatgatttgaaatggcatgctccgcccaagatttttctcatacagtactactactctctagtatagattttagtagtaccttgacatcttcttccttttgctcgcgcccgagaaggaatcagtcctactactccataggagtttttgctctaacaattactggaatttaccgcatatttatcttccttcacacggtacactggaatttcattctggttgttacagtaccagtaaagttaagaaggggccaaatttgtactaggtgcacctttaagaaatgtcgccatcttggatcatcctcatccatgtctgttattactgctagtagttactgttgagcttgtgtttactttccgagtaggacactctcagattgcagcgtgcttgcctgcctgttaaaattaaggggattcaatttcagtggattgagcagatgtggttcttggatgccaaaaacctgtgcagggggtgtcatgtgatctcttcaatggcctgtggtacccaacagtgatgagcattggcccagtccttgacaactcgctgcagtgcggccccgacgccaagttcagcgcccagctgttcgacctgaggcgcctccggacgctgtctttctacagctgcttcccggcgagcaaccccacggccatcccgaccggcagctgggagaagctggcggggacgctggagacgctggagttccgcaccaacccgggcctgaacggcgccatcccggcgtccctcggccgcctggccagcctgcagtcgctggtgctcgtggagaacaacctgacggggcccgtgcccgcggagctgggcgcgctgtcgaggctgagacggctggtgctgtccgggaacgggctgtcggggccgatcccggtgacactcggtaacgaccgccgcgccgacgagctgctgctgatcgtggacctgagcaggaactatctaaccggctctctgccttcgtcgctaggtggcctcacggggctcctgaagatggacctgagcagcaacctgctgcagggcagcatcccgccggagctcgcggggctcaggagcctcacgctgctggacctcaggaacaacagcctcaccggcgggctgccccagttcgtgcagggcatggcgtcgctgcaggacctgctgctctcgaacaacccgctgggcggcggcctgccgcagtccggctggggggcgctggcgggcctggccacgctggacctgtccaacgtcggcctcgtgggcgccataccggggtccatggcggccctgacggggctccggttcctggcgctggaccacaaccgcctgacgggggccgtgccgcccgagctcgcccggctgcccagcatcggcgcgctgtacctgaacggcaacaacctgacggggacgctggagttctcggccgggttctaccagcgcatggggcggcggttcgcgtcgtgggacaaccccgggctgtgctacaacgtcgcggccgtggacgcggcccacgcgccgtcgggcgtggtggtgtgcaaggacctgcaggagcccagcgtgggcggcggcgcgcgggacggggacggggacggggacgcggaggaggacgggacgaagcccgaggcgggctccagcctcgtggcctcctcgtcgtccggcatgccggttggcagtgtcggtgggctccggtacctggtggtggttcggggaatggcggctgcggttcttgggttggtgtccctcctacaatagcaagcaagcaggttcagaagaagaacacggagaaacttgaagtaatgctaggtaggttagcacgaagtagtttctgcgcgttctctgtgatcttttggcatttgtttttggctgctggtggcttaccatcgtcagatggtgacggaggaaggagggaacatggatctggatggtgtgagccacagattacattacagtagtagagtaaactatgagagttcttgtggactgaaggtgtgtagtggtggatagggtagcttctccggggttcttttgtgtgtaattagcctgtgtcgccctgtggtgtcatgttacaacagcaagtggaaatctaagctggttcgtccgttgttggagaatcagaaaaaaaaaaattgtcgtgcttcattcacatcacatggatacacagtttcctgttcttggagcagaagaactggaaagatctctcgttatctctatttgctatagaaagaacatagcggcggtatctgcagacgatacaaatggaagaagagcgggcaagcagcacgacaggatggagcggcggcgccgccgcatatgtccggctgccgcctgccggcgatctcggtgtctcctgctgccttttgcctttgcgtgttctcgagtctgaaaataaaatcaaaaatatggaccgagacgctgattgcgcagggccccgcgctcgcagaggagtcagaaacagaaaggacctgtcaccttggaaagctggcggccggagcggagccctcacagacaggctgcgctctgcctctctggcactggcaggcggcagcggcagtagcgctagtcctctacaggtggaggctggactgcacctcgacgtgtaggaactgtagcgtcattgtggtactccggcgtctgtaccggtctactctacacttttccatcccagtacgctttgaaatatttacaaaaaataaatgtatttaatgatgatatcactagctctagttgtctttttttttattttatcttctcttaaaatacaacaagtacactattatagatatataatttatcactaacattatttattttgaaaacgagggagcaccggagcagtactctgtactcctagtgctacgcaatggcgcggtggcaccacgcaccaggcaccagcctgcgggtgcaggtataggcgtgctagcacctagcagtatggggttgggctgcacgtcgcagtactagcgcgtagaagcaatcgatgctctcgccgaaaaacaaaggcacaggatcagtggcacagctcgtaatacaattgtcgtttcctccaaatgattttggatttagttaaattataagaaatgctaacagttagcaagctgtttacttggctttaatccaaaatgacctcaactgtttatacagta

SEQ ID NO: 596 - protein, 478 aa, Zea mays
MRRARGRRGLLLLLGVALSAAALLRGCAGQQGEDGSDAPAAAAAETAPMEEKERRALYAAIESFVGKGWNGSGLYPDPCGWSPIQGVSCDLFNGLWYPTVMSIGPVLDNSLQCGPDAKFSAQLFDLRRLRTLSFYSCFPASNPTAIPTGSWEKLAGTLETLEFRTNPGLNGAIPASLGRLASLQSLVLVENNLTGPVPAELGALSRLRRLVLSGNGLSGPIPVTLGGLTGLLKMDLSSNLLQGSIPPELAGLRSLTLLDLRNNSLTGGLPQFVQGMASLQDLLLSNNPLGGGLPQSGWGALAGLATLDLSNVGLVGAIPGSMAALTGLRFLALDHNRLTGAVPPELARLPSIGALYLNGNNLTGTLEFSAGFYQRMGRRFASWDNPGLCYNVAAVDAAHAPSGVVVCKDLQEPSVGGGARDGDGDGDAEEDGTKPEAGSSLVASSSSGMPVGSVGGLRYLVVVRGMAAAVLGLVSLLQ

SEQ ID NO: 597 - DNA, 3646 bp, Zea mays
gttaaagatctaaaccggaagaatgagtgactaaaataataaaagtgtacccttttagtcacttttagctcctaagaagaagctaacctttaatcagtttgcttttaacccctggatccaaacaagtcctaaatcaccggtataactaggcacaatgcctcatcagacagccaactgccaatcccaaattctactttgttgtccatttctaattttaatgcctctgcctgcacgtatactatttttgtttttgattaagtcataccacataggagaatcactcaatttattagtaattgtattgtatgaactgaatcatttggcgtatatttggctttctttaagcacaggcacactgctaccaaaagcattaggcgcttaagcatcacccttgtggctggcacgagaaccatttgattcacgacagatttagcgcttgtttgaagtgttggctaaaactagcaatctacagggaagaacaccatacattagtactccgtcgggacacgccaccacatgccgctgaaatatatccgcaacgattctcccagctgcttatagctcagaagcaagagccaaggccggcagctaaccacgactcgtctaatcatccctggaccatagcgattaataaattgattaagctagtacatcgcccctagatttccggcagaattaagaaaaccgcgggcagcagagccgatgccgatggcaacaaagaagaaggggctgttggtactgcagccgcagtctataaagataaaaattgtagaagtagtaggaagcttagccggagctggcatggcaggctgctgctgagtgagcagcggtgggggcctcctggctggcgcgtggaaaaacccgagcaaatggcagcgtgaagcacgtccgagactgaggtcaggcgtcgggcgggggttgcggccaggggagacgaatgaacccctgcccccgcctggatcccatcgcaaaagccccctccccctctccgccttcgcgcatattatattcgcgcaccatcgcagcaacttgcacgggcgccgatgactagttgcgccagatgcactgcatctgctcggcgtggtgcctccaacgtccaacccctcttcctcttgtctctcgtctacctctcttctgcccctctgcgtccgtgtctccatcgtcgtcgctgcgtgaggttgacgacgaccagtcacaggatctgttcgttcctcatgcgacccagctagctaaaactggcatgcatggacatgctacgctgctgcgtcaatccatctcaccaggtacgctgctgtacatgctgctacgagcctacgatcgatagcagtctgtgccttcctttgctcgatgccgatgtttatctgcatgtgatcgtattcgtatgcacggccctccgccctctcaagctgagtgctttttggtgggcccatcgtcctatatacgctcatcagttcactgacgacgatataacgactgttggggttcagaaactacatattgtggtgctcgcccgatctctttcttgtatattcttcttattattagtctctctctctctgaaagaacaaggaactagatgtcttgttttgtgcctcctactatacctttgcgtgtttttcttgcttttgtccatggcttttcaccggtctgctgggtgaagtaatttacacgcatgtcttacgcacgcgctccttcagttgtccgcatatctgatcataacatcgcttcattcatgtgctgacgagatatttttcgccgccgagactgcagtgctagctagctagatctggcctgattcgccgatcgagcggtggtgagacggagtgcttcagctcaaagactgctagtggtaggctggtagctagctgtgtgcctgtgtgcagtgtgcactgccactgcatgcgcggcgccttggacttaagacggcagcacacgcacgcgaggaggcgtcggctgaagcgagcgctccggcggctccgcttcgctcatcaggttcttgagccccggaaacgatgagcacgacccggccggaggacacccagcaactgatcaacagtgccgccgctagccccaaccgcagcgcaccgtccgccgcgcccagcgatatggagaggggcagcggaaccgccgcgtcctcgtcgcgcgcttcgacgacgtctcactcccaccagagggccacccacagggtggtggaggaggaggaggaggaggagcctagtagcagccgtggcggcggcagcctctgctccgggtacctgtcgctcccggctctgctgctcgtcggcgtcaccgcgtcgctggtgatcctcccgctcgtcctgcccccgctgccgccgccgccgtcgatgctgatgctggtccccgtggcaatgctgctcctgctgctcgtgctggcgttcatgcccacgtcgtccaccggcggccgcggtggaaccggaccgacctacatgtagataatcacatcggttttttttttcctttctttctcttgtcgtcctttcgtttggattttgtgacagagggaggtcttgcgatggatcagttagtcctcagcttctgctcttctcgatcgtacgatgtctctgttcggctaattaatttgcataggggtatatatatgctgcctagatcttaaaagtatttaactctttttttgcattgttcaagttctcatcatttctgcactctgttatggtctccactacattatacaacacacgtacagcatttgggtaggtgatcgaccgtgtgatacatatagatggccaatagccggcctggagcacggcacggcccgtagtacctgggcacgacacgatacggctggagccgggttcgtgccggcacggcttgatgggtagtgtcgtgcctgggccgagcatcgcgtacgctgggccggcacgggcacggcccgattagcccctaggcacggttagacactattatgcatgattagatctaagcacgactagttagctgtgtgttgtactcttttttttctatctagggttttctcaaaagggtaagtttttacctagataggtttttaatgagtcagtcattgtactaaacagctcaatattaactattttagtatgttttaactgtgtttgtgaatgtctgactaaaattttgtggtgtagtgctaaacgggctaaacggttctaccgtgccggcacggcacggctaaggagccttagtgccgtgcctgggcctaagttcatgcactagtgccgtaccggcacggcacgcctaataatcgtgctaaacaggccgtgccctaagcgagccgtgcctggtcgtgcccgtgccgtgtcgtaccggaccgcccgtttggccatatgtagtgatacatacgcgagcgaatacttgctaccagctcaccatgacaaaaacggttacaaaaatcaaaacaacacttttttcccctgataataattaaataatattgatcgcactttctttttcgaagatactagtatattacacgcgcagacctcttgtaaacgtaatacttatatagtacactcacgaccttactttcaccaccgaaatcctcccatatcgtgggggttttttttttgtcattgttgatgataaatagtcgggaggcaatcaggcaaagctcgtcagcatcggaccaaac

SEQ ID NO: 598 - protein, 146 aa, Zea mays
MSTTRPEDTQQLINSAAASPNRSAPSAAPSDMERGSGTAASSSRASTTSHSHQRATHRVVEEEEEEEPSSSRGGGSLCSGYLSLPALLLVGVTASLVILPLVLPPLPPPPSMLMLVPVAMLLLLLVLAFMPTSSTGGRGGTGPTYM

SEQ ID NO: 599 - DNA, 3201 bp, Zea mays
taatttagctagaaggcgttggaatggtagcttgacctgtagcttttgcaacaacaatgagagtatacatcatctcttttttgattgttacattgccaaaagtatatggagaatcatttactttgctttaaaaatagacatgcccattagcattaatcatattatcgggtcttgggaatctaataatgctctggcatacaaaacattattactgactggaatatccgctttattttggtccatctggctctgtcgaaatgaggtggtgtttaatcataaaccaataccatcaattgtgcaggttattttcagggttactcactggttcagattctggagacttctacagaaggaggaaaagcaccaacaaattctcgatgcctgtcgagctttggaggtggtggcgatggaagtttttgcaatgcatggatggcgctcgaatgcaagaattgaagatggctagtgttttctatagtcatggcattttgttttctttgagttagtttaattattcaagcaattgctctatggtccaataatcgttatgtaatggctgtacgcatttgtatgctaaagccggaactcttgtttccataatcaaaaaaaaaatagaaaagacaatacatgctgctgcgactgtgcatcggaatcgcgggatgtgcaaatatactaatgctctcgtgtttagtgcagtaaccaaacccttccttgatttgatattaaggaactgcatctgcatcggattcccgttgaaaagtaacgcggcattatttattggtatggtcacctaaaatactattttataatatagaccgtattatttatataatagattttgaaatagataatggagataattaagctgttgaagatagcctttaactagttagtaccgcagtacgtgagtggtgacttgagggagacctctcgagtcgagtcttgccgacctggggcctgctgcgcctggatgaagagctgtgctgagagaatcattaaagcagcaccgggtccttgctttgcgcgttgctgttcgcataaacaagagatcctagttctactcccaagcaatgtatccgtcagcccctccggacgcgtataacaagttcagcgccggggctccgccaacggcgccgccgccgccggcagcgtaccagcagcagcagcacggggcgaacatggacacttcacgccccggcggcgggctgaggaaatggtccaccggcctcttccactgcatggacgacccggggaactgtaagtcgttcgttcgttcgttcgttccccttcttctccagatacatacagttcaatagttcataggaggccagacagattccagtgaatatggctagctattcgagctcagttagttaccacttgacacgcgtttctttcttccatggcgcccacgcccaggtctcatcacatgcctgtgcccctgtgtcacgttcgggcaggtcgctgacatcgtggacaagggcacctgccgtgagtcaatcaatctctttcctctggttttctctcctgaaacaactcagtcagatctcgccgactcactgtggctttggcagcatgtatcgcgagcggactggtgtacgggctcatctgcgcgtcgacggggatggggtgcctgtactcgtgcctctaccggtccaagctgagggccgagtacgacctggacgaaggggagtgcccggacatcctggtgcactgctgctgcgagcacctggctctgtgccaggagtaccgcgagctcaagaaccgcggcttcgacctggggatcggtaagcgcatgcagtgcaaattgcgttctattacgtgcgtgtgtgtgtgcgcgcgcgcgcgctcataaccatacggcctgctgaatgtcgtcgtcctcgtgtatgtgtttgtgcgagaaggctgggaggctaacatggaccggcagagacgaggagttgccggcggcggcgcggtgatgggggcgccgccggccataccgctgggcatgattaggtagatgattgattgatgcgaaatggcagaacttgctttcgtggttcttttgtttgactatgtaatgtatcttcgtttccatcgattctatgtaatttaactgtccttttttttgctctctattgtggaggacgctgggtgtgaatagcactgttttggatgggtttgtgattggtctagatgacttatataaggtgcttgtatacattgtttgtagaggggagttctaaatacgacgtgacatagagaatataataggagagctgcaggagtgcgtggggagcgtggttgcatggtgtcacctttccatgtgaccaacgatggtgacagtctggactggaccacttgattagcatatgcaacaacacaccagcaccagaagaagcaatgcgatgcgacggtggattggagtgtattgggtcagatagattggaggtgagcacttacctgactgaagctccaggttttgtggtgtggccggcgaatggcgatcacagagaaggtttcagagattggtccggcaggcaggcagtcatcataccaaaaggacgtggttcgtccatcacccaccttaaccgacgtaatggcctgataaagcgggaggagggtttgcagtttgtcccaatgatctccagctggcttagctagcgtcctggtccgattgaatccagcgtgtccaagaggatgacgcgggtttgtgcagtttgtgaactagcttcaggagcaagcagcagttctgaacatgcatatcagtcacacctaaacctccaaggagctttcttttgacagactttatcccaggagaccagacaacgcgcaccagtggtgttatcacgaccattccagaggaaagcacggcggcgggagtcaacctttctgacgatgccacaggggggatgagcaatgctgacatgacgtaaaccagctgtgaggtaagcaatgcacggagctgacaaggaccgttcgaccggccgggttcaggagaagagagctccaaccggagaggaatcggtcggatttcggcagtaaggtattgtggatagacaatttgattttcgtggttgacaatgggagacctagatatagctcaaggggagactttcaagtttgcactgcaacaccgagatgcaaggcgcgatgcattttcggagctggcatggataggggctaggctagggtactcttgtcgaagttgatattcag

SEQ ID NO: 600 - protein, 191 aa, Zea mays
MYPSAPPDAYNKFSAGAPPTAPPPPAAYHQQQQQHGANMDTSRPGGGLRKWSTGLFHCMDDPGNCLITCLCPCVTFGQVADIVDKGTCPCIASGLVYGLICASTGMGCLYSCLYRSKLRAEYDLDEGECPDILVHCCCEHLALCQEYRELKNRGFDLGIGWEANMDRQRRGVAGGGAVMGAPPAIPLGMIR

SEQ ID NO: 601 - DNA, 3046 bp, Zea mays
ttctaattgaataatggtttggttgaatacccgctgccgctacattttcctgtttgaaacatcacgaagacgaaattcgagatcccggaagcacaggtatgcagaaggctttgtttatgcttctagtttagcagacaaacaaatacttacaatcaatgttttttttttgtaaaatccaggaaccaattcatgaaaggatatcaaggaatgtcgctcaaggcttacgggacctatgattgctgatagaggatcctggggcagagtttgctgtggggtgcatctctggtaccaatattcccgtgagagtagtaagtagtatgcgcgcatgccatatgcgcgtcctgtgagggttgccattgcgtcttgctgaagcagaggtatccgcatttctttacgatctgtgatgtaatgtggtaataaactccaactggaggtggttgtgtttatgtgattgtgagcaaccgccatgcgccgctggtgagatttgccgtgtttggagcacgaggggagataaattgaaaattgagttttttaagctggtgtcttcggttttgctggtgtgctcatttttatcattagtcgtgttttttgttcagttttgttttgtccttctgttctatagcactaaaagggtaaaattgagtaaaaaaacacaactaaggataaaaataagcacatcagcgaaattgagggcaccctcttaaaaaaacctttcaagtggtttgagtcgtgcagccatcactctgtcacgtacctttctgaaatggaacgtgtaaaattgcaaataaccaagttcattatgttttagcgtaattgggcttttcctctgtagtatttttttcttcaagaggcttcatcagtacgcaacactcccagtaggctcactctgatgtccttgtctcccgattatactagtaaacaacacgggttcccgtggtctcctcagaaggcaactatgacccggaacccctacagttgacttgtcatggcttcgcgatctgtgactgtgatctatactataaggtgaacaagatctctttgtctactgtagttgcagcaccagcagcagcagcagaagagcagcgcctgagctccagcaataatggccgagaagggcgtgaaggtgttggggatgtgggcgagccccatggtgatcagggtggagtgggcgctgcggctgaagggcgtcgagtacgagtacgtcgacgaggacctcgccaacaagagcgccgacctgctccgccacaacccggtgaccaagaaggtgcccgtgctcgtccacgacggcaagccggtcgcggagtccaccatcatcgtggagtacatcgacgaggtctggaagggcggctaccccatcatgccgggcgacccctacgagcgcgcccaggcgaggttctgggccaggttcgcggaagacaaggtacgacgcgcgaactgcggtgcagccacatgatctacttactgacgcagggcagccggacgagccccgcgacgactgacttctctgtactctactctagtgcaacgctgctctgtacccgatcttcaccgcgaccggcgaggcgcagcgcaaggcggtgcacgaggcccagcagtgcctcaagaccctggagacggccttggaggggaagaagttcttcggcggcgacgccgtgggctacctcgacatcgtcgtcgggtggttcgcgcactggctccccgtcatcgaggaggtgaccggcgccagcgtcgtcacccacgaggagctgccgctgatgaaggcctggttcggtcggttcctcgcccttgacgtggtgaaggcggccctgcccgacagggacaggctcctcgccgccaacaaggcccgccgtgagcagctcctctccgcgtagatatggctagtaattctggagcagctagtttcaccgccgacgctcatatattgctgaataaggactggttgcacttttgcacgttgtgcagtgcagccgaggtttggatgacctctgcccctctgttccatttcagaatggtagtcccataataatgcatatacatcatgcataaccttcgtggcaccgcacggtgcgtcaaactgttggcctgttgcccaatcccagtagctgattttcttcaggcgtgcaaggtagcaacagaaagtaacacatagaaacagacatttcttcttttttttatattcgttcagattagatcagtcctgtactgggatcggcccacaaagtgcgccggtccagacttactgtccgaaccgaacgtggtactgccaaggtacatctacacaccatgcagcacagtattggccaacgtccaccgccgaacagaagagcacccacaccagaagcgacagctgcaggtgacgacgattcaggacgctatccacgtagcacacagcagcgatcacaatcacaacatatactgatatacacacaacggggaagatcgaagaggccaggccaaagtccgcagcagcatcacgggttcgcctgctgcagggcctccgcggctgcggcgccctcctccgtcctggtcttcctcttcttggccctggcctcgctccactcgccgtaggagtaggacgcgaggccccagagcgagagcaccagcgccacgcctttctcgctactgaacctctcgcgcaggaagatgacggccgccacctccgtcaccgggatgaacaccgcgatgaggatgcccgccagcagcgtgtgcacgcagaagatgacgcccaccgcgcccaggaagaagcactgccacagcaccgccgaccacgccagcaccgcgtagtaccgcgcctccccaagcttgtaccgcctcgcctcccgcgggatcgcctgcatgcatactttttttcatttatatttctccagcgtttccctttactgtgtgcacagtgcagtttgtgcatcatgcatgcggccatgaccttctttatccttgaaaaatatgtcatgtcatgcgccatacttttccaaatccaaaaaaaagaacacgtgttggtcgtgaacctgcattcttgttactatccctatcagagactatcagtagc

SEQ ID NO: 602 - protein, 222 aa, Zea mays
MAEKGVKVLGMWASPMVIRVEWALRLKGVEYEYVDEDLANKSADLLRHNPVTKKVPVLVHDGKPVAESTIIVEYIDEVWKGGYPIMPGDPYERAQARFWARFAEDKCNAALYPIFTATGEAQRKAVHEAQQCLKTLETALEGKKFFGGDAVGYLDIVVGWFAHWLPVIEEVTGASVVTHEELPLMKAWFGRFLALDVVKAALPDRDRLLAANKARREQLLSA

SEQ ID NO: 603 - DNA, 2631 bp, Zea mays
gatatatggtacattctgaactaaaaagaaacatagcactctgttaatgaaacagaggttgattggtatagatgcacaagatgccgaaagactgtagtttgtgatgaaggggttggtccggacgattgtaacgtgacttatttatagatgccattgcatagtgtttgtctcaagcctcatgtgtaattgaatcacgatagataatagataaaagatgttgtctgtttctgttcttgtgatccaagtatacagctcccagcatataagcattggaaagtttctgtatctgactcctatgatcctatcagcagttgccccaacagcatctcaagttttcaacacagaacaaacaagatcacagctgctccgcctgtgtggtcagttcatctagttcttgtcagagcacgcaacgccgtgtcagccggtgctagtttttattccgaaactgattctatttttttacagtattttatctctgaattgtagcagtagcgttcgaacagctggtttaactggtttaaagctgcagcgaacagaattggtttgaagataattttaacgtctcctgattacgcattcccatgtgcgtacatgccgagtgcattcgcgtatatgctgaactctaaagccttagacgagtctccgtgtaccaatggattgaatatggcaatccaaaaaggatttcgcactaaacgagctacacttgaaattaggaataaaatatttttttaagtttgggtaaaataaacaaacatctagagttatcctaataactcagactatattttaagttggaccgaggtagcatttgaatgaattaatggtttactgccttgtttagaggtaaattgaagtcgaacgttaaataatgacaaatgaaagaagccaccaggataccgcgcatttatctcatgctaatctttcctgctatataaaccagaccaaccctgcaggctgcagggtgaagcagccggtagtactcaaccctcaacacacccagtcacaatggcgacatccgtgaagcgcagccacagctgcagatgccaagtactcttcctgcttgcgttggttcttctggcattcgtctctgcgagtcctacacccatcagcggcaagtagtgcacgactcagtctcgtattttggccatatacgtttcggtttgtacccgtcgtcggttcatctgttccttttccttggacatggagaagatcgattacatgtctgtttgcgatgttcaggtcagagcattgacgacggcaggaagagcaagacaacggtcgtcgtcggcggcggcaacgaggcaatcgtcgacgaggacaacgacatattcaacgggtgccactacaataaccagaatccccattattcgtcggcgctgttctgctgcagcaaggacaagctgtgctgggcgtcgttgccggagtgcgccgccaactgcccttgcaagacgaactgctagacgatgatgagcttcgagtctccagttcatacatgatccatggttgtgttattggatgaagatgtactagagaggcaatcgccaaagatgcagtcttgatagcaactgagaataatcgtacgatagatattgggctaaaccaggaccaggagtatccaaaaattgttttatagcacccttggccccggcgccccgccctcaccaatcatgcatgcgcactgctccacctcacgccgcctcctcctctccgccccctcgaccgcgcttccactaccggtggtcggcggctctcgctacctcacctcacgccgccgcgatctcattcctaccctctcctgaccacagtgttaccaacgaccactttgccacgacgcctctgccctagctccgcccaaccgttgcctcgaattgcatcctctcatgacccgattgtatcctctaatggcaaaataaacacaacacatcaccttggaccttaccacaatgcgggcgatccaaatttttccttgagactcttaaaaattctagttcaaaaatgaatacaaatagaggctgattataatccgattcgatccttaaattttgcttacattttgtagtgtaaaatctagagcccgttatcacccctaaccacaccgcatcacatctattggaaaatatgacatatgctcaatcccccaatggatgtgacggttatctcgccaagcaacacaccttttccttcacttttatatatatattaggtgagtgcccgtgcgttgcaacgagaccactacattgcaacctttaatatcatacagacttctctatatgatagtacaatacttgcacattgctacggtttatatatatcataatagctacatgttagatcaaggacacacataattgagaggtaaaaattagattccaatactttctcaagtagtttaactcaaattttagcccgcccgtcgtctgggtcgtcgtcgagcccgccgccgacgcgcccgccaccgccgaggtgctccgcggcaccgacatcatgtacaggcacctcgccttcaagcccgaggacaacttcaccaccgccgacaccgaggctcacgtgcagcggaacgccgcgctcgcgcacgtcgagaagcaccgactcgccggcgtcctgcacttcgccgacgcctccggcgtctac

SEQ ID NO: 604 - protein, 108 aa, Zea mays
MATSVKRSHSCRCQVLFLLALVLLAFVSASPTPISGQSIDDGRKSKTTVVVGGGNEAIVDEDNDIFNGCHYNNQNPHYSSALFCCSKDKLCWASLPECAANCPCKTNC

SEQ ID NO: 605 - DNA, 3216 bp, Zea mays
attttgttgcgttgtttcatgattaagtaataaaaacaagagatcaacactatgctcttttcttaatcgatcattctaaaaagtacatgatttttgtcgactttacacccactcaaaattggtgtaagcacatgccatacaagaggttcatagaaacgattatcatggccttaaagaaatataagattgtctacagcatgaaacgttctagatgggtggtggatatttttaaattggaaaataaaattcagactgatgcttcaattgacataaaatgatattttctccgtgccaccttctcagcaatttaattttttctatgatttccattacatataacatagttggcaaaacattattatgaaggattaacaccagctacctcgttctacaagctatgtccatgggggtaataacaggcgaatggaatttgttaggggtgagtggagtacgcatgtttcacgttcaagtatacattaataaaaacattggtattttgttcacttatgtctttgtgtgtaggatgtatatattcttccaagaaactttatgatcgatctgttaatttatgaggacaattcgtgccgatatgtcatccctccaaacatacagcatagacttatcaatatcgctaaagaggattaaattagtgtacggttgtcgacatattcgtctatcattaaaaattctatattgactatttagaaataatttgtatgatattgataatgttcgatattatttcaatctattttagtcagcgtatttataataattatatatttatatcatcaatataatattattgttatgataatattttatagtacgaattttatatattatgaaatatcgtttcatatatatgttttatattaatttttctaatttacttaagcatctgacgctaagtgtcctgtgcccggatcggccagagcggtcaaatggttcaatgctttacctcctctggttggtgtccagcttgggggcagctgcctttcatttccattcttccagttgcacccagacccaggcaggtcatcggcgcccacaactccaagttgtataaatactccgtcgaccgtctcataacagtcataccgccgaaccaaatccaacgtccacagaaaagaaaacacattcccgtcgactcccctagtttcatcctattcatttctccccccaaacactccagctactagttactcgaggaatccatgtgcggcggcgcaatcatcttcgactacatcccggcgcggcgccgggtgtcgacagccgacttctggcctggttctgaagcagacgccgaggacattcatgcctcgcactccactgacccacagagaggtaagccctgcttccgtctttctctgctctccaggcgacaacacgccatccaggcagcaagctgcaaacggtcaatggtgtgacgccgtgctgccgactgttcccatgcagcgccgccgccgcgcgcgaaggcgaagcctgggcgccgcaagaaccagtaccgcgggatccggcagcggccgtggggcaagtgggcggcggagatccgcgaccccgtgaagggcgtccgcgtctggctcggcacctaccccaccgctgaggccgccgcgcgcgcgtacgaccgcgccgcgaggcgcatcaggggagccaaagccaaggtgaacttccccagcgacacctcctccagcgtcaccgtgccgacggcggtgtcgaggtctgctgctgctgctgctgcacaggccccggccgttctcccgctgcccaaggtggaggcacagactcaggtgtccgacgaggtcaaggagttgtccgaggagctgatggcctacgagaactacatgaacttcctcggcatcccttacatggagggagggactacagctgcaagtgccaccacagctgccgcctccgcggccgccggcgtcgccgaagaatcgcaggtcccggctccggccgggctgtggagcttcgaagattactactacccgccgtctctgtcgctctttactgaatgatgaacgtgctttgaccgtgcctgttttggtaacacctttgtgaacagatttcctgctcgtcgtagtcggtgtgatgtgatggcatcaatcgagctcctgtcctgtaattttgttgaacccatccattgtttcgtgactactgtgtgtccctgtaactcgcaagttgaggcatcaaagtttccagtttaactctgatctgtgctgctcagcagttctctgccgtaccgacgaatttgttttgttttgtacgtgattgaattggttttacgggtacaacgctgtaacacccggctttaaggaacaatgtcaggtgcatctcatacatgcgccaaaaagacaacatatataataacagagtgtatagagataaatgtcataaaacatcagagaatttattacatagcggaagacttattacaaaataacataataaagataaaacgaactaaggatcgtcggcgccaatgtcgactgggaaacgccacctagatcagatcgaactcctcagtgttaggcggctcctcctgaaccacctgatcatctcctgtggggggggggtgtgagacagcaagggtgagctcacacatgatcatcgctcaacaagttgtggggaataatgtgacacgaactcaccaaaggtgggagctcatgtgaagtgtaaggctgatcaatgataggggttaaagctgagcattgcttttaagtagttggtcaaaattttattagcagttactaagtgtaagtaaataccaaaccttaaataaagtaattgaacaaattaataataaacccatgcatatgcaaatgacaaaattgaatttaagttccataatttaaacatcagagagtcctgagctgctcatgaccgtgagctcggctagtataccagttttacactctgcagaggttgtaccctttacccacaagtcatgttacccatctgccaaggggtcatgaatcccattcacctctacctaggaagcgcggcagggcaacactacgaggcctttacaaagttccactagcttccgaaaacccgctacagtttatgggaagatccagtacagggttcctggctgaccgccatcgcagcaaaatcaaccagggacctccccgcactgacctctcccctactgcccttgcccctttcgggtaaggtagtcttccactagctttcctaattagtcagccaagg

SEQ ID NO: 606 - protein, 230 aa, Zea mays
MCGGAIIFDYIPARRRVSTADFWPGSEADAEDIHASHSTDPQRAPPPRAKAKPGRRKNQYRGIRQRPWGKWAAEIRDPVKGVRVWLGTYPTAEAAARAYDRAARRIRGAKAKVNFPSDTSSSVTVPTAVSRSAAAAAAQAPAVLPLPKVEAQTQVSDEVKELSEELMAYENYMNFLGIPYMEGGTTAASATTAAASAAAGVAEESQVPAPAGLWSFEDYYYPPSLSLFTE

SEQ ID NO: 607 - DNA, 3253 bp, Zea mays
caaaactaataaatgtcatatcacaaggaaagatatgaatattggattcgaacaattcacgtttatttaagtagtggaaacacattaaataataaataacaatgcttttatatataacgtaagatggagagtcaatagatagtagcgaatctcggcatcagtttccttctatcctgtgtgctcaagaatagtggcatggcctatgcgcatccataggtatatattatggatgtttgcatgcatgtattaattccttgacaccttatcagtatgccaagcacactatcaacaaattgctgggctgcaccaagatttgtcctcgcgtcgtactctaagtcaacgctagcgcgtctgcatgtagctatactatgtattattttattttatcacggtttagtttaaaaataaactaatcagacgataaatatttaaaaaaatgtcttaacatcatatgtcctgcaggagtgcatcctttgtgtacccaagttgaccagacagatgtgaacgtttacgcaattgctgccttaattctatcataaaattgtgttcttatgacaaagatatactcttgttggaagtatggccctgggatcaacccggctagtccaaccaaccggcctaaattgcactcctagctagtattgtcttgtgtcaaatggtctttttatattgtggaataggccctcttcagttaaaatggacattatatcactgtgaacgatatgtggtctcatttgtccttagccattgatatctcaatcttttcaatcgttgacctaagccattgaagcatgcctcactacaagtataaaattatagcatcaccaagatatggacacacatgactagatatatatatcattaatattatgattaaaataaattgtttgactaaatatatataagttaaataatgtagaataaattgaaactagaactaaaagatttgccacaaggcctataaataccgggccttgtccttgacatccactccacatccaaacactgtaacaacttgtgtagtacttaatccctcgcacctcatgaatcccaacttcaacagtgtgtggagcgctcccgagatcaatatgatgaactcactcatcactagtcacatcgccaacaacacctacacaaacaaccagcatgttgtggcaagtcgtagtgccattgtgaaccacaataactttgggatgccaacggaggtcgttccacccgtggacaacatggacatgatgcaaggctatctaatggatgatacggatgccatgaggcttgttcagggacaacaacatatgccaaatgttgttcctaatcaaaggaggcatgcagtgaagttttggactacagatgagcacaggtctttaattaatttttgcattattcatttggaatctttgtcacatatatacatcttcgttcagtgttattaattttcagtacatttaataagcatgtggtagtattcataatttcataccatgagatgctgagatttgattttcactgatcattagagtatatgatggtaggacatctatttttatctgattattatattaatcttgcttacgtactatatataggaatttccttcgtggtctagaagtgtttggccgtggtaaatggaagaacatctccaagtacttcgtccccacaaggacaccagtgcagatctctagccatgcacagaagtatttccgcaggcaggagtgcaccacagagaaacaacgctttagcatcaacgatgttggcctctacgacacacagccatgggtgcggcagaacaactcctctagcagctgggaggcgctcaccttcactgctggccgtgcgtacaataatacaaactactgtgcctttaacagcctcccgtatgccagcagccaggcaagtaacaaccaggtagctacatggattacagaccagcaggcaactgcaagttcttctatagctcctccagcgacggaggagagccagatatataaccgataatatatataatggtcatcagcagctgggagaggctttcttcatatataatcaataggtagatagatatggacaacgtccattgactagtttaatttctatctatatgttttgtatccaatgatgcatgtaaaacctagttggttgttaaaggtcattagtaccatactatatatgggctagaaacagtttcattgaaatttgcccctgagcaatacaatgaaattttaccaatgtgttatttatatattaatgtgtctacttgtatgtgttagttatatttcgcctgtcttcctcatatctatgtgaatatgttacaatgattgtatataattatgcattatctttttgtaaaaccttgcgtccaaaagtcttcttacgccccaagctctgcacatggaacgggtgcggtccgcatacacatagtacatcgatctatgtaaaatgctgacctagacatgatagcttggagtgacaaggatcataagctgattgtcaacatcagaaacttccaaggtggtacacgggtactaaacccacaccaactataaccattaatgggataaggtgttagaatccgagtattccatggtttatttggaacttagtgaaaactaggataaggatcttaacacatgcattgcatagaaaaaactcattagcaagaaaaataataaaatctactcgactagcatctaagtcaacacaactaattacaaagaaatttagagcctatttatacatctcatcacatgcatgcactagtagaaaacaactttatacctacggtgaggtctaatttttacacgattttggttatcaaatgccacagatattaaattagctatcccaactcaagaaccgccagtacacacaatatttcacgggcggttccgcaagtgcaaatcatgcatttctacatgcggccaatagaaatcatatttttattggtggtttcttaagaaaaatgtcagcacaaatccatgattttaacagttggttctcttaagaagccaccattagaaataatctctatcctaattttttttgagttttttatatgacctcgtacgaaaaaaccaccaaaataaaaattatagatctctaaaagttataaaattttgtagttgacaactttttattcgaaatcatttcgaccctcaaaaattgcatctgaatttgtcaaatttaaaatgtaatttttgaaaacggccttggatgaaaaagtaccaaaataacagtactataaacacagatattc

SEQ ID NO: 608 - protein, 241 aa, Zea mays
MNPNFNSVWSAPEINMMNSLITSHIANNTYTNNQHVVASRSAIVNHNNFGMPTEVVPPVDNMDMMQGYLMDDTDAMRLVQGQQHMPNVVPNQRRHAVKFWTTDEHRNFLRGLEVFGRGKWKNISKYFVPTRTPVQISSHAQKYFRRQECTTEKQRFSINDVGLYDTQPWVRQNNSSSSWEALTFTAGRAYNNTNYCAFNSLPYASSQASNNQVATWITDQQATASSSIAPPATEESQIYNR

SEQ ID NO: 609 - DNA, 2666 bp, Zea mays
ttctgtacaacaaaagtgagaggccattaagtttttgctagaaatgaataccacttgtcatttaacttgaaattgttatgatttaagtcatgatatggatattgatggatcttaatatactgatcgaacacaagaccacgtgaaagaaagagcgatgaaccattaattttttgctagaaaagagtaatggactaaataatgttgtatccaacatctgaagttgtgtatccatatagggtatgcattgaatataatccaccaggtgaggctaaaatctgtagctacttaatatagatggtcctctcataactttaggttttttctgtacaacaaaagtgagaggccattaagtttttgctagaaatgaataccacttgtcatttaacttgaaattgttgtgatttaagtcatgatatggatattgatggatcttaatatactgatcgaacacaagaccacgtgaaagaaaaatcgatgagccattaattttttgctagaaaagagtaatggactaaatcaatgttgtatccaacatctgaagttgtgtatccataattccatatagggtatgcattgaatataatccaccaggtgaggataaaatctatagctacttaatatagatggtcctctcataactttaggttttttctgcacaacaaaagtgagaagccattaagtttttgctagaaatgaataccacttgtcatttaacttgaaattgttgcgatttaagtcatgatatggatattgatggatcttaatgtactgatcaaacatgtacaagaccacgtgaaagaaaaagcgatgaaccattaattttttgctagaaaagagtaatggacaaaatcaatgttgtatccaacatctgaagttgcatattcatatagggcatgccacaatgttaggctacaatctatgactagctacttaattaataaagatggtcctcacataattttagggttctttctccataacaaaagtgagaagtcattaagttttttgatataaatgagtggtgactatcacacttgaataaggccacaacgctagtacaatctttataagtagtatccactagttattggcctcttactatacgtagcacactagcactcctccatagggccataaccatgccgtcctacaagaaactagtgatcgttggcttcgccttaaccttgctccttgtgtcattcggtatgtgtagctaactaacttgtagcaagcgttgcttccatctgcgaatgtgtatatgtctatatgtactagctagctagcgattgctaacagtacgtacgagaatttgttttgtggttccaggaatggatgcgtctgcaaaactgtgcagtacgacaatggatttactcatatgcggcggagcaatcccaggcgccgtgaaccaggcatgcgatgacacatgcagaaacaagggctacacaggtggcggcttttgcaacatgaaaatacaacgctgtgtttgtcgcaagccgtgtgcactggaggaacaaacagaggcgcgcgccggagacgaagcagccggcggcgctggagatatgatgagccggacgatggcagattgagtgatacgcatgacaaatgtttagacaccatatatataaggaataaaatcttcaatactataaagcactagttatgaccagtcgttctgcatcacgcatgaagcgtgtagatttatattcctctcttaacagcccctacaactataaaaacattcgacgtcctgcgacctgccgcacgcgtgaaccgcataggtctatgcccctctcttaacagtgggtcgttacgccatacatagaccataaaaccacccaaagatcctattagtaggctgttactctacagatgggttgtgagaaccacccaagtctaacatgatagcaagcggcacatagccgcaacattgccttatagtaccaccccactagataaaggtgaacgagcgaccaagcatgctataaaaaaagggtcgtgctcatttttcactcatatctttcctaatccttgcgtcctccccctaatcccccaccttgcctataaatagagcggcaaggggctcgctcatgccatcccaacctcagcccactcccacacaaccagaagcacaaggatcgttcgagcgttcattcgatcgttcattcgatcgtttgtccaaatatttttagtttgtttgttcgttcgtccaatcgttaatccgatcgttcatagttcgttcatctattcattcatccaaataaatattgttcaaccattatactgctgaaattccgaccgttcgtccgtccgttcatccaaataattattgttcagtcgttatgctgccgaaattccgacagttagttcctccgatcgttcgatcgtttgtccgttcgttcataatccctattcatcgttcgttcgtacgaactattcatcgttcatccttcgtgcatatgaactattcatcgttcgtccgttcgttcgtaatccctattcatcgtccggtcatacgaactattcaccattcatcattcgttcatacgactattcatcgtttattgttcgttcataatccctattcatcgttcgttcatacgaactattcatcattcatcgggtcgttcgtaatcactattcatcattactattcatcgttcatctga

SEQ ID NO: 610 - protein, 107 aa, Zea mays
MPSYKKLVIVGFALTLLLVSFGMDASAKLCSTTMDLLICGGAIPGAVNQACDDTCRNKGYTGGGFCNMKIQRCVCRKPCALEEQTEARAGDEAAGGAGDMMSRTMAD

SEQ ID NO: 611 - DNA, 5785 bp, Zea mays
gcaaatcataaaccatgcactctcctgtccctccaaggattgtttgacagaagggaattgaaacaactaatttttttactatttagttttaaatagtaagaagagtttagcctcttcaattcactactcttaaacatgtcctaagcgtcgttctaatttaatttttaaactttggctatatataagaaattattaatatttataatactatttttaacaaatttatttagagatctaaatatcgctaaatattttccagaatccaatcgcatttagaaatagggaaatttagatccataccattaaaagatcaccactttggatccataccattactatctcacttacatgtgggtccacatgagtcaatgacacgtggggtccatggtatatatctaaagtttggatcttttaatggtatagatccaattgttccttagaaatatttgattttttccggctaaagttcactccgtcattcagaggcacgtgcgtgtgagtctaatgggccggacgagccagggaccggagttaaaagatatggggcagtttggtcttctcctttgtttttagtgattttgtttttaaaattttatttgatacccatccgacggacatcaaattcagcagcaaacgaaaatcatttttttaatataaaattacaattaggctactgaataggggacgataaatattttttattttattattttgagcatgagactatgggaacagggccgttgccagttgggcaggttcagactcgctgcgccggagcccctgatcgtaattttccgtgggcgctagggcatattcgtaatgtggtcccatgggataaattcgattcccctcgaacggcaaatatctaccggagcgcgtctcggggaggagagagaaagtcagatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtttgtttctctgtccttgtattggcaacgtatctggtgctcaaagggtacggtgctcacgtgcgagaaatttggagagatcagtccatgcctacgctcatcttagaatctgccggatagatggtgtgttggtttgcctgtatggattgtattggtctgtgccgatttgtagaatttcgaaccgtttggtatgattgatattacctggtatataatatgttttcgtttgcactttggaatacttgtgggcttgacgctgagtgccttgagtctgtttttaatcaagtcgaattgggatttccggttagttggcatgatttgggaaatgggaagcgcccccttttgttggtgcgttagggaatttttataattattgaaagggtttatgtttatctcgagacttcagaattctgccggtaggtgaaatatgatcacaactgatatctaggagtttagcagcagatttgaaaaatgtaacatcctttgtggaatccagtcgtgataaaatgtgtgtagcgctgcattgaaggttggtcacagggggtgtttggttccacccaactaaagtttacctgtcaaatcaaatgtttgaatgataattatgggaatacagtattaaatatagtataattacaaaactaattacacatatgaagattaaaaggcgagacaaacttactaaacctaattatgtctatttttaatactcataattgatatttaaacatttgatgtgatacaaactaaacttgggaaccaaacaccccttcagtttcagcctagtgattcgttctttttaactaaaaatcatttgttttattgggaaacatgctcgtgcgttgcaatagaacccaatatatattagaacagattcggactctacagacgcgagttcttttttagcttgtatattcatgagtcctaatcatatatacgagatacataaggcgtgacccggtatgtcttggaatcggactccttatcaattgatacgagttgttttagccttaatgagtacatgtcacatacgagatatactaaatgcagtttgagaagtaaaaaaacaagacagttgaaactctccactgtccggtagctaggaggaggtggaaaagcaaggataaaaaatgttagttctttaacatcatgtgtggcgcagtggtgagaagcctttctagtttccactgagccaaaggtcctaggttcggtgcaatctctgtaaaagtggagacataagacatgtctcggttatttcttctctaaatcttacttctgtttaagccgctagcattagatctgttttatatattaaaaaggacaggaaacaaacgccttgatatttattatgctccaaattaatttagtctagagcttctctttaatttaattcggagcctcgcttctacgagcaacaatattgggcctcagagaggggtgcatgttagtagaataggttgtggagcgtattgtaacgacttcttctaagatttatttactgttctcgtcttacatttcaatttgtcttagatagaattgcattttgtaccatgattgcacgtgtgttgctccaactcatatggactgtaaaaaagctttatccaatgatcacattatgtgttccaatttatcttgtgaccgcacttcggcaaacaaaaacataaaagaaacactgcatgctatagttcaaatgggtatacaaatatgaaacataacccattagtcttcaactctttaccgtgtgtgcacataataaaatttataaaaatggcattcagcggttgatggctggcctatttgcgtgctgtactggtggttactccttaccctccatgtgcgtggggcacattgggagtgtttggcttctggctacattggcagtattttaatattttgttaaagtgcatccggacactcccattgactgctagtgctagcccttcacgttttgtccatagtcacaaagtttccgggtcgatagggtcgaggaacgggttcaaggaacgtggtacgctacttatgagaggtttttacacggtgggaacgaaaatgaccctgcgtacctgggtcggggacgacgtttccgggtcgagggtcgctaccactatacccgtttcttgtgactatggttttggcctttcggaattcggactatatatgtaaaggaaaaagggacagtacacagtaggtagcaacacatcatctctgtttcaaactcctcatacgttagtagagaggcagagttagacacgcaagattgtagcgacagacggaaaaatgtgtggaaagagattttactcctttaatattacatatagtgtaatgtagtatggttgatttgccggtggcatatctccttttgcaactgctgcagctttattatgtgtagtgtgcctatcctaagtcccaacacccttgggatcggaagtctttgttgggttgctctagaagttcagattggtatttttagagcaggcctaatcatagagccaaatgtttggccacaagtcaaattataagcctagctatgcaatagctgcttctttttatctacaaaagtttttttattattatgtgatactttttttaaccatttccacattctattccatattcattctcacatacacttgctatttaggccaactactacgtaggctcctgtgccagcttgttgcttgcatgagagccaagctctcctttctatcctcccttctcttctctacatcagcaaaaataccgattagtttggctataaaacaattattttacctgctctttaattttctaatgtgcagagaatacttttgttgtcacctattttgatgaatggatgctcctatggcatatcatcccctgtttttgtaatgccaaaatactgttccagttgaattgtctacactcgttaatattgagtgcaaaggggcatcactacgatttgtatgctaaaaccaagcatgttaactagaccgtaaacggtgatattgtttgagttggtgtgctgttgaggattttgttgtttttgtaattttgatgtgacaaaatcatcacgatttataatgcatgatcagataggcttatttttcaacgcatttcacatgtttctgctctacgcgagcttatatacttttcggtgtaataataggtggtgattgacttcactgcaacatggtgtcctccgtgccgcgccatggctccaatttttgctgatatggccaagaagtccccaaatgttgttttcctgaaagttgatgtggatgaaatgaaggtcgtcgaactttctaactctctttgcagattgtcatgatatattatacttgttaattgcattgtctgtgttctgatatctattttctgagcagaccattgctgagcaattcagcgtagaggccatgccaacattcctgttcatgagggagggcgacgtcaaggacagggtcgttggcgcagcaaaggaagagctagcaaggaagcttgaactacacatggcctcgtagatcagtgatgccgtaatgtagtattcgcctaaataagaggacgcctcgcctcaactctgagaaaactagtgcttctgtgatggtaattcgtatgagagagtgccccctttggtggtacttcttcgtatgtagtattaactcctgtcttaatatgttgccctgcttgtgcttttcataccatgtttgctctttcagctgaggtgttatacggtaaatcggagtcaatatctttgaaattgattaactgtagtcacctagcttttttccctaacagccagcttgtttagccgcgatgcgtgggttatttcggacagccatgtcttctcaggccagtatgctttctcttcctgaacactcaagtttccagaattacggtcttgtctggtattgagaaccgatatttgcatgttcatttccaaatcaatgttgaatgggacatttttttctcatctggtattctggtggcatttttgcaagaaatgctactgttaatttcaattccgttatttgtacccctataaaaaccacaacttcaaacattgctagagtcatccaaccaaatgtccatcacaatctacagttcttctaaatgaaccaaacaaactacgcttagattcatctcaaatcgatcatacttttgaaatcaagaaatgagatcagtttaaacttctcctttctcttatctaacgaccaatcttatttgaatcattctacctcatcattaatcatcaaccatgtatatctatatttatatcactataaatctttataaaacccaccacttcaaacattgctagagccacccaaccaaatatccatcacagtttacacctctactaaatgcaccaaataaactgcacctagattcatctcacctctcatttctcttactcaaatctaaaaatcaatcttaattggatcattcaacctcatcatcaatcatcaatcacaaaaaaacaaaaatgtcacgctatcgccgactcctcatctccccttcccattcaaatctggcaacggacgatggcgagggtggcgtcgatgtagacctccttgaccggctcaccctcgagggagcggcgcaccatccaggctaacaccaggcagaggatcaatgagaccacaacgatgtcagccatggtgagcagcacccacaatgagacga

SEQ ID NO: 612 - protein, 128 aa, Zea mays
MAASEAAAAAATPVAPTEGTVIAIHSLEEWSIQIEEANSAKKLVVIDFTATWCPPCRAMAPIFADMAKKSPNVVFLKVDVDEMKTIAEQFSVEAMPTFLFMREGDVKDRVVGAAKEELARKLELHMAS

SEQ ID NO: 613 - DNA, 4100 bp, Zea mays
actccagcaaattgttaaggtgggtttcagaagcgtttgacttccacatgaactccagcttctatagtacaattgatttgtgtgagtttccttgattaccctttatgattagtgggttgtcgcgagagaaaacgtaagttatatattgcgtaaccagtggcatggtgggtaatttttgtacaacttcatgaggagatataaaaacggtgtttttgtagcaccctctaagagtttcatgaatttcatgaaattgacctctagtttcgatttttttaaagctagagctcgtggagctggaccagtttaggtggaagaagttggaatgaagttgaaatttttgaagtgaagctctctcaaatagagcgttaatctacattattaatatttgacttctagataagcgagaatggcactctttagaatggagcaactgggcttagctacatttatgatatggaggttcttagttgtattatgtagtttcttagctaccttttatatttggaaaaccgaaccagactctggattgtacatagcctttgaagaattattcaagagttaattaagctgtaatgccactaatattaaggtttaatttacccttgtattcaatacttaacgttatatattctctataattaaacatagtccaacttaaaaaatgatttttgcaaagatagaattatatgttttttgtgagggctaatagtttaatgaagttatcgatgtttgtatatttcacgactataaccttcacctctgaccgctaatgcttgtttagaccatatttggatgttgttgtattaaaatattatgttattaaggaaccattgttttagcattgtattcaaaattatgaagtttttatatgcaaatgattcactcgaaaaaacaaaagtatcaaaatcatagtattttctctctctaaaattccaaaaatattttacatctaaagttgatgtcttggcctcccgcgctgttttaccttcctcctctggacaccaaccacaggccgacaaccgagtaagccggtcaattttggtatcctgctcatgactcatatcaggcggtagccgagcagccgcccagctttctcatgccagagcaaacccataggtccagtccaaatccaatccctgttgccatcagaatttcaggggcagccatggccgaaaaggagagcaacggagtgcgggtgtgcgtcaccggaggagccgggttcatcggctcctggctcgtcaggaagctcctcgagaaaggctacaccgtccacgccaccctgcggaacaccggtgcgtctgatggcggctcctcagctcgatccgcgcgtcgcgaaaggcgaaacacgccaaaggcgaaaggagtgggtcgggtctcgtgtgtggctgcctgatgattcgggaatcttagccggattcgtgtgctggtgggtgtgcaggggacgaggcgaaggcggggctgctgcgtcggctggtccccggcgcggcggagcggctgcggttgttccaggccgacctcttcgacgccgccaccttcgcgccggcgatcgctgggtgccagttcgtcttcctcgtcgccacgccattcgggctcgatagcgccggctcccaggtgaagcttgccgtcgcgttcgctcccttcactgttttactagtcaacgagtggtcaggcggcgacgcgccgtgctgtctcttcttaattttaagttgtggaaaattactgtccttgcaaaggaaaaatttgatcagactgagtatgagtaaagaccagtaagacagcacaaggattgcgagctgcgactgcgagcagaggaaacgtcttcacagttattcttgtctgccttgtttttctctatctgaagcaaaatcttgtggtgcccatcgaccgcgtatagcagtataagagcacggcggaagctgtggtggacgcggtgcgcgcgatcctccggcaatgcgaggagtcccggacggtgaagcgagtgatccacacagcctccgtagcggccgcctcgccgttgctggaggaggaggtctccgcctccggcgtcgggtacagagacttcatcgacgaatcttgttggacttcgctcaacgttgactatcctctccgaagcgcacacttcgacgtaagtagtatacaagcgaagcttcttctgatttctgaactggaacgcctgatcacattaatattttttagctgacggccatttgatttgcagaagtacatactgtcgaagctgcggtcagagcaggagctcctgagctacaacggcggcgagagcccggcgttcgaggtggtgaccctgccgctggggctcgtggcgggcgacacggtcctcggccgcgccccggagacggtggagagcgccgtggcgcccgtgtcccgcagcgagccctgcttcggcctcctgcgcatactgcagcagctcctggggtcgctgccgctggtgcacgtggacgacgtctgcgacgcgctcgtcttctgcatggagcggcgcccctccgtcgccggccgcttcctctgcgccgccgcgtacccgacgatccacgacgtggtcgcccactacgccagcaagttccctcacctcgacatcttgaaagagtaagatcaaaagcgtccacagcgacagcatcaccctgcacacaagaactgactgccgatttacgtttctgttgcgattggttggattgatctgcgtcaggacggaggcggtggcgacggtgcggcctgcccgggacaggttgggcgagctgggcttcaagtacaagtacggcatggaagagattctggatagcagcgttgcctgtgcggcgagattaggttcccttgacgcatccaagctcggcctacagaaaggataaaagctcgaagcttactcataagcaccatggggaacttggattgttcgctgtccactatacgcgttcgaaatttggaaactagacatactccaataaaacaagaggtaaagaaacgtgggctaactgatacgcgttgagcagttgagctagcctagtttagtccacctgtgtgcagggtttaaaacttcgacgaaattttatgacttgcgataattttaggcctctaaatatcaaccatacactctaaattgtatatgtgcatacacatatagccatatggacgctctgatctagcatcctacacctatgcacctctctaagaacaactccaacagcctcactaaatatatcagattcggtaaaaaaaaacccagttaaaattgtatccaatagtctcgttttattcttatcttctctatccaactcgtcatatggtccctttcgctagacatctttgccaaggcgtacggctcgccatatccctcgtcatgcccaactgtcctcccgccgtcgcagagaattcactctcccacgcgcccttctgctcccgcgtcgtccaccctgctactaggtcgcaccgtcggcaccgcgagtacgcctcgtcctcctgctactaggtcgcgccgtccgccccactactaggtcgcgccgtctaggtcacaccgtcggcaccgcgagtacgcctcgtcctcctgctactaggtcgcgccgtccgccccactactaggtcacgccgtcggcaccgcgagtacgccgcgccctcccgctctctctactaggttgcatcatccacccccttgacctccgcctcaccaccaagtgaagcacgcgccaccacattcgtccgttcgcgtgatggattcggaggcacatcgcacgcatagagatatggggcaattcactgtcagtttgatgctccggcgtgtgcttccttcaacaagctttgaaggcctgatgccagtggatcagcccgatggcaatcgaattgcccttgcttgagttgtgatgagcatttggaaatgctgctcagggacgttgaccatgaacacaaggaaaaatatgtttctttctttgcttattaatcagcagattctagggcgccatgtttatttctttatttagtcagctgggaactacaacccgggaaaataattagataagtcccacggtctgtatgtcacattcacttgcggcatgcctgttcatctgcgtgttcgggagattgcatactccgttccc

SEQ ID NO: 614 - protein, 357 aa, Zea mays
MAEKESNGVRVCVTGGAGFIGSWLVRKLLEKGYTVHATLRNTGDEAKAGLLRRLVPGAAERLRLFQADLFDAATFAPAIAGCQFVFLVATPFGLDSAGSQYKSTAEAVVDAVHAILRQCEESRTVKRVIHTASVAAASPLLEEEVPASGVGYRDFIDESCWTSLNVDYPLRSAHFDKYILSKLQSEQELLSYNNGESPAFEVVTLPLGLVAGDTVLGRAPETVESAVAPVSRSEPYFGLLRILQQLLGSLPLVHVDDVCDALVFCMERRPSVAGRFLCAAAYPTIHDVVAHYASKFPHLDILKETTEAVATVRPARDRLGELGFKYKYGMEEILDSSVACAARLGSLDGSKLGLQKG

SEQ ID NO: 615 - DNA, 3743 bp, Zea mays
gcaacaatcaaaagtaataatcgaaaaatacaacccaatatacaaaacaaacgaatcagtgagacaccatacattggtatacaaaattttccaactcgaatctagtttttttttaagaagattggaatggagagaaagttaagaaaaaaggtgggtgcaactctcggctagcagaacgactgatttatagaactacctaactcgcgacaagatctatgacaccgacctaggaagccaagtcagcgtcacggcagccctggccgccgacgccacgtcagagctcggcgcctaggccatatgacgccaagctaagagtacaaaattagaaataagtcaccgagtagtctaaatgttattttttgtcgaaaaaagaattaaaaaacaaaaaatcggatttaatcactgcaatccatctcgaacggaacacaagggacattttagctctatccactccgtcatgcgctattgggaaggcgaaaccgaagccgccattttcttgcgcaaccccgtgtagacgtaaacccgggctcgtgcgtgcttacacaccagatttgtatttgtattaatacggagtattacccaaaactagcagagctgaagaaggcacctagcgcgcgctcttcgtttcgtttgatcgcacgcgccaatcctgacgcggtcaaccgcgagtccgcgaggggaggggaggggaggcgaggagaatgacgcgcaccgtgacgaccacattggtgacactgtgttccgtcatcacgatactacaggcgccgcgcgcgtggctcctcgtatcccgaccgacggtcacgtcgcgcgggcgcgtcggtctcgcatcgcactccactttttccactcagttgcgtcacgattttcacgacgccccggcccccgcccgtcgatcccttccctcctcctgcttgggccgcgcccgcggttcgggttccccccttcggccgtccccctatatattaaaccatgcccgtcctgtggaaagcatccgttcggatccgagagtcctgcagagcccatcctgttcctgtccccctcgagcaatcgagctctacagctgcacgctcgcttacgcggagacacagacgctgagacacacgcaggtcatgatgctgctcatggactcggggagccgcggtgactgctccccggtctgcttggacctcagcgtcggcctttcgccgccgtcgccggggagcggcccggaaacgacagctgacgctgagagactcgaccgtcccgccactggctgctgggggccacggacatcgtccctcgctgacgggaaggacgaggtaactgaccgacgaccatttcctcgccgctcggtttccacaatctatcggcgtcgtcgtcgtccctgaaatcctgaaaatctatcggcatcggtggccacaatgctgtgtgatgacaggccaagaccctggaggccaggctcacccaggtcagcgaggagaaccggcgtctcaccgagatcatcgcctacatgtacgccagccaggtcgccgcgcggcggagtcccgacggcaggaagaggagcagggacagcctggagccgtcgaattcgggcgacgccaacgctgccgtcgagagcgccgccctcagcgacgagggcacgtgcaggcggatcaagctcaccagggtctgcaccaagatcgacccctccgacaccacgctcaccgtcaaagacggctaccagtggcgcaagtacggccagaaggtgacgcgcgacaacccgtccccgagagcctacttccgctgcgcatacgcaccatcctgccccgtcaagaagaaggtagactcctggcccaccatccgtccatccccggcctgacattgattcgattcacggcggcttctttcactctgtcgctaatggtcgatacaataactctgttcctcggaacaggtgcagaggagcgcggaggacagcgccatgctggtggccacgtacgagggcgagcacaaccacccgagcccgacgcgcgccggcgagctccccagctccacctccatcaactcctccggcccggccatcacgctggacctcaccaggaacggagccggcgccgtgcgggggctcgatgccgccgccgaggtgcccggcctcaagaggctgtgccaggagatcgcgtcaccggatttccgcacggcgctcgtggagcagatggcgcgctcgctcaccaaggatcccaagttcaccgacgcgctggctgccgcgatcctgcagcagctgccggagtactagtgtctagcgccccacctgctttcagtgcttattacagatatcagagcgcccgtcttcaaagagcagcagttctttcatcgtcaggaaacaaaaaaccgctttacgtttaggggtagctcgaaaactctatttttaagggatttttattatctcaaagaaaaataaataaatttttttaagaaaatagaaattcctttgaaaaatagagtttctaaactaagacttagggttagtttaggaatcacatttttccatgtgatttctatttttctaaagaaatttagtttatgttctttttagaaaacagaaatcccttagaaaaataaagcttctaaactagctcttacttagattagattagagccaatctccctcaaatttattataggtgtacctgtaagtttctttcttctgttcttctggctaggatctgaactgcactagtactactgtacatttcacatgtgcatagagccatagaaggccgttgtcaagtaccgcgactgcgtcctacctgaatgtgatctgcctagttatcaatagggaattttatactataaaatttaagtatagaatcagattagagagtgagtgaagaagcatttaaatcgtgatctattactatcccttttcaaagcatacatttgatctctctagaattagagatggagtgttgggtacaactaacacaactcgaccaatataacgggcgagctcgagccataatttttgacccgcaacaattcatagttgggtacagaccatgatttttgacccaaaacctgatccaactcgaaaaccttcgacccatagcttgaaaactcgtctcgacatgtcccacaggggggcacgtgccaacccggcggctatgcacgggtcaggtgtgggttgtgtcaaacgatccacgagccaaccattttttctcctcgaacatggttcgacaactatgcacaggtcaggcacgagctgtgtcaaacgacccgaccgatcatgacccggcccaaacccgatccgagcagaggtttgaacaggtctagatacagcccaagtaaagttttatacttgtctcgtcaaatgtttgaataataattccggatattaaatatagtctaattataagactagttatagatggagactaaaagacaagtcaattttattaaatttaattaaaccaatacttaatagtcttaattgatatttgttttaattaatattcaaacatttaatgtagcacagactaaactttagtaaccaaatatcccttaaatttagaaactaaactctctcgatggaggatttcatttcactgtttctaaaacaagctgcaccaccagttaatgtatacatacatgttttgatccaatgtaaattacgtagccatttgaaatcatatctaaactgaacacagtcacttcaacaaatacaatatatctcatgccgacaaataaacatgatcaaccaaaaaatattgattaatataatattcatc

SEQ ID NO: 616 - protein, 302 aa, Zea mays
MMLLMDSGSRGDCSPVCLDLSVGLSPPSPGSGPETTADAERLDRPATGCWGPRTSSLADGKDEAKTLEARLTQVSEENRRLTEIIAYMYASQVAARRSPDGRKRSRDSLEPSNSGDANAAVESAALSDEGTCRRIKLTRVCTKIDPSDTTLTVKDGYQWRKYGQKVTRDNPSPRAYFRCAYAPSCPVKKKVQRSAEDSAMLVATYEGEHNHPSPTRAGELPSSTSINSSGPAITLDLTRNGAGAVRGLDAAAEVPGLKRLCQEIASPDFRTALVEQMARSLTKDPKFTDALAAAILQQLPEY

SEQ ID NO: 617 - DNA, 2704 bp, Zea mays
tttttcataaaataggctaaaatacaaaaaaaatcaggaggttcgctgtgctgcgaacagaggtgcgagcgaatataataggatgtttgtgtagtaataagctagtgtattatcttcttaatccttacttttttatttggtttgtgaaatagaatgagggcacgtttggtttgatggactaaagattagtccctccattttagtctcatttaatccttaaattgccaaacggtgggactaaaacagagacgactaaactgttttagtctctagtccctaaagggatgactaaaagggactaaactatataaattccacttttttacccctcttttatttcagttgcactaatggtatgagaatgccaaagggtatttcagtcctcttatgattcatttaatatgttttgaatacttttagtccctataaccaaacaaggtagagactaaactttagactcttaattaaattttagttcatggactaaaggaaccaaacaagccctgagtcgatccataaccatctcatctcattccttatagttagttagtttgttagttaacactaatataagaaatgcggtcacctactaaagctgagcaatagactcatgatgcacaacatcgctgaatgtcgtcagttcaaactttacacgttcgtaacagaaatacagataagaatgcatcttatccgtttgacttcaactgcattttagactagacagcatgcacgaattgaccattccatgaggtcctttgatctgtacaatatataaatgcacctaacagaatcaaagttgcctcaacgctatgcatgtcctgttcgtggaattctattgaactcatacgtagaaaagattggcatgccggccatattttcgtgcaacgggactatttttccaagcatactggagaaaattcacatgctctccactattaatagcccccacatatttgcagtatagcatccacaaattaaactcacgcacacacacaattaggtcacatacacacatcccggctgcctccctaggtagcagcttctacaatggaggcatccaacaagctcgcagtcttgctcctgtggctggtcatggcagctaccactgccgtgcacccttcctactccgagaactcgcctcaagactacctcactccccaaaacagcgcccgtgccgccgtcggtgttggcccggtgatctggagcacgaagctgcagcagttcgcggagaagtacgccgcacagagggccagcgactgccgtctccagcactcgggcgggccctacggggagaacatcttctgggggtccgccggcttcgattggaaggcggcggacgcggtgcgatcgtgggtagacgagaaacagtggtacaaatacgccaccaacagctgcgccgccggcaaggtgtgtggccactacacgcaggtggtgtggcgcgccactacaagcatcggctgcgcgcgcgtcgtgtgccgcgacaaccgtggcgtctttatcatctgcaactacgagccccgcggcaacatcgccgggatgaagccctactgatatattgtgcctgcgatcaatggcaactgatatattatatctagacacgagcttgttgcagcgcatgactttccacgtgatatatgaataagattttataactagataaatctttgagtgtagtcataaataaatcaaagaggtttgttatttacaagttgctaggatccttctatcgtatgtgcaacttcgtcaaacttcacggctcgtgaaaaccgaatgtttgacatatgtgaactagtagggtgtttggtttgagaaataagttagttcattatcttctcactcctcactatttttgtttggtttgtggaatagaatgagttgattcatcaacacctcatttcttaaagttagttagtactaacatgatgaatgggaccatctcactaaatttaaggaatgaacttataattcaacacctcatctagaatagagtgattcctcaaaccaaacacctcctatttgcagagcgtcgccactgcacgggcgtgacagatgggaggtgtaagtcttttgttatatatctaagtcttaaaaactacaaacaaaacattgttgaagaataggcgatcggtatcagttgagaaacaaatataatattggatttccaaatcgtattggataatgagggcttaaccagtcaatctttagtcccgactgcatacaccaggattaaagatggcctttgatatttgttggtcatttcattttgaactctaaaagatatcaaatgacaaggcaacacaagttaaaacataaaagcttctccacctaattaactcttctacgatggttaatcagttggagaaggcaataggatatttcaacaaaggtaatcaaatcatcatgtaaataaagaggactaaaacttatctcttatatggacgtgtatattcacatttatttcatttcttgataagtacttaacaattacaaatataccttgggctttacacgagatatactcctaaaggtaccttcgaaggctgagcagccagatgcttggggtttgaaaaacgtaatttatgcatggtattgttcctctatttatagtcgaaagggtacagctctggtgaatttacaatcgtgaccttaggcctatacatttactctattttacatgccaagggcgaggttttgctttttcttc

SEQ ID NO: 618 - protein, 167 aa, Zea mays
MEASNKLAVLLLWLVMAATTAVHPSYSENSPQDYLTPQNSARAAVGVGPVIWSTKLQQFAEKYAAQRASDCRLQHSGGPYGENIFWGSAGFDWKAADAVRSWVDEKQWYKYATNSCAAGKVCGHYTQVVWRATTSIGCARVVCRDNRGVFIICNYEPRGNIAGMKPY

SEQ ID NO: 619 - DNA, 3752 bp, Zea mays
acaagccctaaaggttgtgcactaaaatccttaggttaataaaagctaacgaaagttgatagtaagatcgataggtaatttggtatggctagttataaatatagacgttgaaactcgccttagtggagtgagtgggtgcatgtataagtgtacaatagtttgtactttgtaggcgttcgcaccgtaaggccaactccaacaatgccccccactcccctaccccatgtaaggtgtggtttggagtaaaaactctctccaacaatcccacaacccactccatatggggagagagattgtgctccccatatatgaagggcctctaatcttctcacacactttaattaccttatctttttatattgatcctttttaagtatggtgtcttgataacaatgtgtattatgacaatataaatagtctatgtttttaacttcaaaactgatgaaaaaatgttaaataactttagttatagaatatagggggtctgaatatgataaatggttggagatgttctagatatgaaggagtatattttaaaatgatgtagtaaaatataatagaaagtataaatagaggaagaaatgtggaggtaatgaatggttggagatagtccagagagagtgagatcggcaaggtggtagctgggacgagcggctgcaaacaactgtagcaaaaactaaaaatggctacttctgcagcaggttttgtgaaaccaaagcccgcgaagaaaaatataaataggtacgaaattccagatcgcgggtaggtaggaggagcagctagattgttagatgaagcacgcaagtggcagctgtatatattgatgaaccactacaccctcgccaccagtcaaacaacgccaagcgcgcctcccgtgaacccagcggcccgtcaagtcaaagcatggacgtgccgctcccgctgctgctcggctccgtggccgtttccctcgtcgtgtggtgccttctgctccgccgcggcggggccgggaaggggaagcggccgctgccgcccggtccccggggctggccggtgctgggcaacctgccgcaggtcggcgccaagccgcaccacaccatgtgtgctatggcgcgggagtacggcccgctgttccggctccggttcggcagcgccgaggtggtggtggccgcgtcggcgcgggtggcggcccagttcctgcgcgcccacgacgccaacttcagcaaccgcccgcccaactccggggccgagcacgtggcgtacaactaccaggacctggtgttcgccccgtacggctcccggtggcgcgcgctacggaagctgtgcgcgctccacctcttctccgccaaggccctggacgacctgcgcggcgtcagagagggcgaggtagcgctcatggtgagggagctcgcccggcagggagagcgaggacgggccgccgtggcgctgggccaggtggccaacgtctgcgcgaccaacacgctggcccgggcgaccgtgggccggcgcgtgttcgccgtcgacggaggggagggcgccagggagttcaaggagatggtggtggagctgatgcagctcgccggggtcttcaacgtcggggacttcgtgccggcgctcgcgtggctcgacccgcagggcgtggtcggcaggatgaagcggctgcaccgcaggtacgacgacatgatgaacgggatcatcagggagaggaaggccgccgaggaaggcaaggacctgctcagcgtgctgctggccaggatgcgggagcagcagccgctagcggagggcgacgacactaggttcaacgagactgacatcaaggcacttctcctggtaagcttacctttcccgtacgagcgcaacgactgccggcagtgacggggacatgctttgtactgtacctttattgcaaattgcaattgaccccgtcccgtcgtgctggggagttggagttttgggtcttgttttctcacatggacggaaatactttctgtggccatatcgtgacaacagaacctcttcacggctgggacggacacgacatccagcacggtggagtgggcgctggccgagctgatccggcatccggacgtgctcaggaaggcccagcaggagctcgacgccgtcgtcggccgcgaccgcctcgtctccgagtcggacctcccgcgcctcacgtacctcacggcggtgatcaaggagacgttccgtctgcacccgtccacgccgctgtcgctgccccgcgtcgccgccgaggagtgcgaggtggacgggttccgcatccccgccggcaccacgctgctggtgaacgtgtgggcgatcgcccgagacccggaggcgtggcccgagcctctcgagttccggcccgcccgcttcctcccgggcggctcgcacgcgggagtcgatgtcaaagggagcgacttcgagctcatcccgttcggcgccggccggagaatctgcgcgggcctcagctggggtctgcggatggtcacgctcatgacggccacgctggtgcacgccctggactgggacctcgccgacggcatgaccgcggacaagctggacatggaggaggcctacgggctcaccctgcagcgcgccgtgccgttaatggtccgcccagcacccagactgctgccgtctgcttacgcagagtagaaatcgatgctcgccggccatccatgccgtccgtatgcatggatgcatggtcaaataaataagcgttgtacgtgggtatcagtgtcacaaactcacaatgtgtatcatgtattgcttcgtcagtggcgtgtgtaagcgtccgatttttttttgtattttattctttttccagaaaaaaatcgccgttgaaatcgcataacaaaactaccgtttcttattttctttaccaaactataaccgttttaaaattttaagcttggtatcatagcctatagtgtcaagcaccagtataaaaatagctctaagcctttggtggaatctactttttataactgattcggtatagcgtgccagtgataataaactgaaactactagggaaaaccatccatttccatcggcggttgatgtaagggaaccaccggtgataatctcattttcactagcggttccattacaacaaccgtcattagaaataaattgacgctaatgttaagaaatccgtcattgaaaattgatggtttgcactagcggttgcttactccaaccgtctgtgacctttgttgtataaaacccccattttcctctcggaccagtactgtttctcgcagtcaccttccattgaaggcaattttagaggtccagatttcacaaaatacaagggtagattttgatctttatttttggaagaaggctgctaagaaaggatggtttatgtttttcttgccaatttttgttcattcttgctcaattttagccacatcttggatctagggttcaccatgtgtgtgagagaagagtatagctaggtttttttctctatttcctcaaatgaggttgcttaagatggttagattttgtctctcctcttttcctttccacgttttgttctcaaatcagtttatccatgatatatttagttgttcaatgaatggtgcatgtgtttgtatggagagagaggaagataggtttggtaattaagattttttattagctactagaaagttagattttatgtttctcttgctaatttttgttcattcttcctcaattttagcaacattttagatctagggtttcaccatgagttagagagaagagtagctaggtttttgtctctat

SEQ ID NO: 620 - protein, 457 aa, Zea mays
MCAMAREYGPLFRLRFGSAEVVVAASARVAAQFLRAHDANFSNRPPNSGAEHVAYNYQDLVFAPYGSRWRALRKLCALHLFSAKALDDLRGVREGEVALMVRELARQGERGRAAVALGQVANVCATNTLARATVGRRVFAVDGGEGAREFKEMVVELMQLAGVFNVGDFVPALAWLDPQGVVGRMKRLHRRYDDMMNGIIRERKAAEEGKDLLSVLLARMREQQPLAEGDDTRFNETDIKALLLNLFTAGTDTTSSTVEWALAELIRHPDVLRKAQQELDAVVGRDRLVSESDLPRLTYLTAVIKETFRLHPSTPLSLPRVAAEECEVDGFRIPAGTTLLVNVWAIARDPEAWPEPLEFRPARFLPGGSHAGVDVKGSDFELIPFGAGRRICAGLSWGLRMVTLMTATLVHALDWDLADGMTADKLDMEEAYGLTLQRAVPLMVRPAPRLLPSAYAE

SEQ ID NO: 621 - DNA, 6349 bp, Zea mays
  misc_feature (1)..(1000): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcccccacaggggcatactggaggcatggctccggcgtctcaaagaagcctactatgatgccgaggacttgttggacgagcatgagtacaatgtccttgagggcaaggccaagagcgaaaaaagtctcctgctgggagagcatggaagctcctccactgcaactactgtcatgaagccttttcatgctgctatgagcagggcacggaacttgctccctcaaaacagaaggctaattagcaagatgaacgagctcaaagcaatcctgacagaagcccaacaacttcgagatcttcttggtttgccacatggcaataccgtcgagtggccagctgcagcacctaccagtgttcccacaaccacatcacttcccacttccaaggtttttggtcgcgacagggatcgtgatcgtatagtagattttcttctcggcaagacaacaactgctgaggcaagctcagctaagtactcgggtttggccattgttggattgggaggaatggggaagtccaccttagcacagtatgtctataatgacaaaaggatagaagaatgctttgatatcaggatgtgggtgtgcatctcacgcaaacttgatgtgcatcgtcacacaagggagattatagagtctgcaaaaaagggagagtgcccacgtgttgataatctcgatactctccagtgcaaattacgtgatatactacaagagtcacagaaattcctgcttgtcttggatgatgtttggtttgaaaaatctcataatgagacagagtgggagttattccttgctccattagtctctaaacagtcagggagcaaagttttggtgacttctcgaagtaaaacacttcctgccgctatttgttgtgaacaagaacatgtcattcatttgaaaaacatggatgatactgagtttttggctctttttaaacaccatgctttctctggagcagaaatcaaagaccaagtattacgcacgaagctggaagacactgcagtggagattgctaaaaggcttggacaatgtcctttggcagcaaaagttctgggttctcgattgtgcaggaaaaaggatattgctgaatggaaagctgctctaaagattggagatttaagtgatcccttcacatctctgttgtggagttacgagaagttagatccacgtctgcagaggtgcttcttgtattgcagcttgtttccaaaaggtcatagatatgaatctaatgagttggttcacctttgggtggcagaaggatttgttggttcatgcaatttgagtaggagaacgttagaagaggttgggatggattacttcaatgatatggtctctgtatctttcttccaattggtttttcatatctattgtgattcgtactatgtcatgcatgatatccttcatgattttgcagagtcactctctagagaagactgctttagattagaagatgataatgtgacagaaataccatgcactgttcgacatctatctattcatgttcatagtatgcaaaagcataagcaaattatctgcaagctacatcatttacgcactattatctgcatcgatccgctaatggatggcccaagtgatatttttgatggcatgctacggaaccaaagaaaactgcgtgtattgtctctgtcattttacaacagcaaaaatttgccagaatctattggtgagctgaagcacctccggtatttgaacctcatcaggacgttagtttctgaattgcctagatcattatgtactctctaccacttacaattactttggttaaaccacatggtggagaatttgcctgacaaactatgcaatttaagaaagctacgacatctaggagcgtactcatcgtacactcatgatttcgtgaatgaaaagcctatttgccaaattctgaatataggtaagttaacgtcgctacaacacatttatgtcttttctgtacagaagaagcaaggttatgagttgcgacagttgaaggacttgaatgagcttggtggcagtttaagagtgaaaaatcttgagaatgtcattggaaaggatgaagccgtagagtcgaagctatatctgaaaagtcgccttaaagagttggcacttgagtggagttccaataatagaatggatgcaatggatattctagaaggtctgagaccgccaccccaactgagtaagctcacaatcgaaggttacagatctgatacatatcctgggtggttactagagcgatcctattttgagaatttggaaagttttgaacttagtaattgcagtttgctagaaggcctaccaccagatacagagctccttcggaattgctctatgttgtgtataaactttgttccaaatttgaaggaactatctaatcttccagcaagccttgcatatttatcaattgataggtgcccactgcttatgtttatcaccaacaatgagctaggacagcatgactttagggaaaatataataatgaaggcagccgacctggcatctaaacttgcattgatgtgggaggtggattcaggaaaagaatttattaggagtgtactgtcgaaagactattcatctctgaagcagttgatgacattgatgatggatgatgatatatcaaagcatcttcaaattattgaaagtggtctggaggaaagagaagataaagtatggatgaaagaaaacatcatcaaggcatggctcttttgccatgagcagaggataagattcatttacggaaggaccatggagatgccattggttctaccgtcaggactccgtagactttccctttcttcatgcagtattacagatgaagctttagctatttgccttggtggcctcacttcaccgataactgtagaattggaatataatatggcattaactacacttccatctgaagaggtgtttgagcatttgacaaagcttgacagtttgattgtaagaggttgttggtgtctcaaatcactggggggcttacgtgctgctccatctctttcctatcttaactgtttggattgtccttctttagagctagcacgtggagcagaactaatgccattgaaccttgctcgcaatctcagcatccgtggctgcattcttgcagttgattcattcattaatggcttgccacacctgaaacatctttccattgatgtctgcagaagctccccatccttatcgattggccacctgacctcccttcaatcattacatctaaatggtctccctgatctttactttgttgaaggcttgtcttccctgcaccttaagcgcctaagtttagtagatgttgcaaacctcactgccaagtgcatctcacagtttcgtgtccaggaatcgctcacggttagtagctctgtattgctcaaccacatgctaatggctgaagggtttacagccccaccaaatcttactcttttagattgcaaggagccgtcagtttcatttgaagaacctgcaaatctctcatccgtcaagcacctgaagttttcatgttgcgaaacagagtccctgcctagaaatctaaaatccgtctcaagtctggagagtctttctatagaacattgccccaacatagcatctttaccagatctgccgtcctccctccagcgcataactatattgaattgccccgtcttgatgaagaattgccaagaacctgatggagaaagctggccaaagatttcgcacgttcgttggaagagctttctaccaataccgaactggcttccttagagttgccactttgaaataaatgagaaggtacaggttctactaattcattttttccagcacaattgatgagtttctcaatatttaaaacatttcatgttctaaacaggcaccttgacgtcacccctcttctcttgaagctccagagttcaggctcaagtcagaagccaatccgtcgttaattctgccgtccccgcggttccctgtttttgccgcttgtattgctccgctatttcagttgctatatcattcattccttggttgtgcacaattgccaatatgtatttctctgacagaatgaagtgataactgtggctagggcttttgttttcatgtgcacaattgctatatcattcatgtggcaattagtataaatactccaggcaatgcaatagagaagatagttcattttcctgcacttgtgcttgtggatggtgtagcagagaagttcaccatggaaccagttccagtaatgtgtgtgctacagtcaaaataggtcttaattctctgctacatacagtcaaaacgtgtctgctacagtccgagtgtttctggagattcgttgttggcggatgatgagctacatttgtacagtatggattgagctcgaggacttgttcatctccttgctctattaccagttaaaaggtgattgcttgttctctattaccaattggattgattacaagtgtgcttgctggcgtaagagatgaaaatgccttgtattttagtgcatcaaaactgaaggtttttggtggtatgctccattctgttcaatgtcctaaaccctacacacaaaatgtaaaaccttaggcgctggtttgcagcatctataaccaaagcgtatcattcattgattgcacggcgcttctgcagcacctatctgttgttgctgctgatcaaccgctgtgatgttcaacaacttgtccgggcgggcgtcaaagctattctcactgagcaggctaccataaacatcgacatccatctgttgttgcaatgctgattcaaaagaggattgaaggagattaaatcacttcctattcaattttaactaagagataatttaattctctctaatccctttttggattgccctaaccgaacaagtccttgttattgggtttaatagcggattgacatattatatgcgaacaactcagaattacacttctactactagatattatctctccaatgcaaatatcaatattacttaactgaatttaatacctctcttctctcattgtgtcttagatatcgtattgaaatcaaatcttacgtaagatccaatttcttactatttcttcatttaattatttatcacttttatcctatgtggcagctgaattaatgctataaaaactggatgatgatgtggatgattgagaccgctctcagatacaattagcaaaatctaaagaattccaaaccaataattcaagattacccacctagcgacattaattagggagacgcgcatgcgcatgcttgcaggaaatctcttggtttcggctcaagtatagtatttcaaagttctacaggatctatctgttgctcctgttgttcaacaactacgtgtccgcacacgcgtcaaatacggatggcaaattcctctttgttg

SEQ ID NO: 622 - protein, 1298 aa, Zea mays
MADFALAGLRWAASPIVNELLTKASAYLSLDMVREIQRLEATVLPQFELVIQAAQKSPHRGILEAWLRRLKEAYYDAEDLLDEHEYNVLEGKAKSEKSLLLGEHGSSSTATTVMKPFHAAMSRARNLLPQNRRLISKMNELKAILTEAQQLRDLLGLPHGNTVEWPAAAPTSVPTTTSLPTSKVFGRDRDRDRIVDFLLGKTTTAEASSAKYSGLAIVGLGGMGKSTLAQYVYNDKRIEECFDIRMWVCISRKLDVHRHTREIIESAKKGECPRVDNLDTLQCKLRDILQESQKFLLVLDDVWFEKSHNETEWELFLAPLVSKQSGSKVLVTSRSKTLPAAICCEQEHVIHLKNMDDTEFLALFKHHAFSGAEIKDQVLRTKLEDTAVEIAKRLGQCPLAAKVLGSRLCRKKDIAEWKAALKIGDLSDPFTSLLWSYEKLDPRLQRCFLYCSLFPKGHRYESNELVHLWVAEGFVGSCNLSRRTLEEVGMDYFNDMVSVSFFQLVFHIYCDSYYVMHDILHDFAESLSREDCFRLEDDNVTEIPCTVRHLSIHVHSMQKHKQIICKLHHLRTIICIDPLMDGPSDIFDGMLRNQRKLRVLSLSFYNSKNLPESIGELKHLRYLNLIRTLVSELPRSLCTLYHLQLLWLNHMVENLPDKLCNLRKLRHLGAYSSYTHDFVNEKPICQILNIGKLTSLQHIYVFSVQKKQGYELRQLKDLNELGGSLRVKNLENVIGKDEAVESKLYLKSRLKELALEWSSNNRMDAMDILEGLRPPPQLSKLTIEGYRSDTYPGWLLERSYFENLESFELSNCSLLEGLPPDTELLRNCSMLCINFVPNLKELSNLPASLAYLSIDRCPLLMFITNNELGQHDFRENIIMKAADLASKLALMWEVDSGKEFIRSVLSKDYSSLKQLMTLMMDDDISKHLQIIESGLEEREDKVWMKENIIKAWLFCHEQRIRFIYGRTMEMPLVLPSGLRRLSLSSCSITDEALAICLGGLTSPITVELEYNMALTTLPSEEVFEHLTKLDSLIVRGCWCLKSLGGLRAAPSLSYLNCLDCPSLELARGAELMPLNLARNLSIRGCILAVDSFINGLPHLKHLSIDVCRSSPSLSIGHLTSLQSLHLNGLPDLYFVEGLSSLHLKRLSLVDVANLTAKCISQFRVQESLTVSSSVLLNHMLMAEGFTAPPNLTLLDCKEPSVSFEEPANLSSVKHLKFSCCETESLPRNLKSVSSLESLSIEHCPNIASLPDLPSSLQRITILNCPVLMKNCQEPDGESWPKISHVRWKSFLPIPNWLP

SEQ ID NO: 623 - DNA, 3037 bp, Zea mays
gccttgggctggaatctggaattctggatcgctggaagagtggaagacaagaattaaaaggcccagaaccgaatagcctaaacggtacaaaaacgggattttcccgaatcaaaacggtaaccgcaaaaacgaacgaaaaaacagtctgctcgttttcgataccgttaccgaagacagtctacccgttttcgtcccgaaaccgaaaaataaccgaagtatacgaaaacgatccaaaaaaaccgataatcggaacggggcggtacgggatttttccgtaccgttttcatccctaactgcagtgcagccagatgaaaacctacacatgggacgtgcagtgatctgcgatagcatgaaactcacgcagagcttgcaggccagctaataatgtattaatgccttgactggtcatgggaacggagaaaaggtagctgctttattagctcttgtctaggagtggatgagcgtgccgattagatcaagaagacgagacgttgatgttgaccgaaacctcacgtactcctacgctgtagtactaggaattaaacactggtaggtgaggctgtttcaattcaatgccctcgcagtcgcagctggttaatgcctctgcccgccggcgtctggagtctgccatggctctgggcaacccactaccagggttggccatttacaggattaccctttactgctgtctgcatccctgttgactgtttacgcgttctcttggccacattgctcgcgtagccatatatacacgtttattatatatctatatatattatgtacggtgtccatagtatactactgctgggtgctggccaatgtagacaacatgtagtggctgactgacaactacttgactgctacaggaatccaagcgctcagactcactcttactggagaccactatatggtttacctgtggcacatgcaaactctccaggggcattctcgggcaatgctttgtggccccacatgtcccagcttcatattcggtgctcgacgccgtgtgactctgccagagtgccacctgccacggacacggagggagggaggtgtgccatcagcgcgcagcatcctccagccgatagcctctcactgcctcacttcagcctcggacctgaacagacctcaggaaaggggagacctggaacgaccgtcgagctagagcggctgcgcgctgcgccgagagctggggagtggggactggggaccgaattgaaggcaagaaagtagaaacgaaccaccacaggcggcgcggcaatggatgagcgcggggagaaggaggaggagcacggagtagtggaggaggagacggcggcggttgtgctcaaggaggtggaggtggagatggagatggtcggcggctctgaagaagcctcggcggcgccgctcctcctcgcgcacccgtgctcgctgctgcagctcctgctccgcgcctgcgccggctgcctggtgcgcctgctgcacggccactgcagcgacggcgccaacgacgacccaaaagctgctgccgacgacgacgacgctgcgcctgaagctgctgctgctgcggcggcggcggcgggcgatggcggcgacaaggcagccaccgtaagtgtcgttcgagaccaccgcttgatatatttgtcggtcgtacacgtaacgtacgtacggtaaccggtcggatcgatcatcgtgtaaacatgcatgcaaacctttgcagtacttgtacatgcaggaggtgtgggcagtgaggaggaggccgacgacgcccggccgtccgagagaaggttccggtggcaatggagggaaccaccactagctagctagctctctagcgcgacgccgctgcaacgtacgtacggtgaccctagcttgttcgcttgcgcgtgatcagagtgcgtagcttcttgtaagttgtaacttacttggtactcgtactagatttcgaaagtaacgtcgttaattagtaagtagtactagtacgtgagtgtggtttatgttatatgttctgtagcttcaatgcaaagaagactgtgtgcatgtgtttgaggattattgtttcgactttcgccgaatgattccaggtagatgcggtagtatgtgattcacacgtcttatttcttggcagcgatccgaatgaaatcaccttggggccgggggcaggtcgggtgtttttattgaaacgaaaaggacgacgggaggcgaaaataaagcatacccgatcgagagggcagaaacgacagcgccaaccttgcactgcactggcgtcttggcagttggcacaacccatgcatgaccgaaactacttctgatgaaccacacgcgcgcgtgcacagctgcgcaggacgtacgcgacgacgaccaccaagtacgacgtgtgccccggcctggctatatgtcgtcgttgttagaaagttaggcatttttagttttaatttaatccagataatcagtgcgatatatgtaatgacatgtatatgcatgtgtgtataactactcgcataagcagtaaacagcaatgaaacatgcataaatacgaagaacagagtgtacccagcggagggaccgatgctcaaggcaccagtggctccattcacacgagacatctcgtgtgtttgttcgatgtagccgtacgaagtcggtgcaggaagatgtacgcagtgcagtccctcgaacggtcgccgggaagaagaacagcagcacgcgtcaacttgggaaggcgacgaacagcaaggctgtggacgatcacgcgagcagtcgcgaagacgctccccaaaaatctgatcgcccgcacacccgtgcaagtgtatctctacggtcggtgatttcggaggcctgctctcccactctctctgtgctcgcagaagatgggacgagaatgtgttgtttgcaattcgcgtgagatgattcgcgtgactggaagagccctccctctccattcttataggcggtcagaagaagggagaaggacaacggacagaaacggtcacgcattagagctggaaactgacgccagtaactgacgtccgttactagccataagacaggaaacgga

SEQ ID NO: 624 - protein, 142 aa, Zea mays
MDERGEKEEEHGVVEEETAAVVLKEVEVEMEMVGGSEEASAAPLLLAHPCSLLQLLLRACAGCLVRLLHGHCSDGANDDPKAAADDDDAAPEAAAAAAAAAGDGGDKAATYLYMQEVWAVRRRPTTPGRPREGSGGNGGNHH

SEQ ID NO: 625 - DNA, 4545 bp, Zea mays
cgaaaagagaggaggcaagcagaggggaggggtagagtggatgaggggattagggacgggtgtactaaatgggcttcttttttcttaatgggcttcaatagttggtttggcacagcggaaatcctagtccgttcagactccaaatcggcccagtagtgtcaagccagttttgatggatataatagttccttttttttgaaaaataggattagtggcattttgatgtagtctaactgtctaaggctctgtttgatttttgtggtcactaaattttggaccactttaactcttaacacttcaaatatgatatctaaattgttatcttatctaagtgttattacacaactttacaactgaaagtttagaccatatgatccaactgaagtgaagtctaactttatccaaagacagatcggtgatacaacaatgccactccttgtggcttggcaatatgaaataaatactccgtgctaaatgaagactgattccgagtgacgacgatctgtgaacatcgatatgtcaaagagaacaaaatcttgctagttactcctgcgagaactaaatcttggagtaaatgacccagtatctcttgctagtgcagagcaaagacaaaaaaaacgcatcctctttcccgggcactaagatggcataaagtggcctctttaatttcaaagggtcacagcacaggacagattctgcacttagttgttgtgactggtaaagcacagtgaacgaagaacatctgaagttgcaaggagcgagtttgtgccttgcagcgttgcactgacatctgtaagtgatgagcaaagtttatccgttttcgaatattcattgtcaaatagtttatttttaaactaaacgacgacaaataaaaaataactagtacaaggacctcgaatagctaccaaacgtagccccgggaagacgccgattcgtgccgacgaaagttatcctctgaatttcacaaagggattccctttcaaaaaaaaaaattcacaaagggattaggcgcactccacccatcatctagctgtcttgagagagctgagccaggagcggagggaagaataccacgcgctgggtccgaaccggagctggactggattcttcaaggcttccattccattccatggggtaaagcgatcccattcccactcctatcgtctgcctccaagacaacagttttaatctgcttgcttgcgctctgctgcctctggttcacgttcaccgcctctattccatggggtaaagcgagcagttttaaatacgagaggccctcgcttgtcactgaagccgcggcttcttgtgccttgcaacctgccgttggggcttcttctctacaaatacgttgcgcgccatggatggcgactcgaagaagctgaggtagaagcggtgcacgcagcagggcctagagcctccgtctgctgaagggtttgatcctgatttcatctatgtgtctggcaggcttcgggttgtcttctttttttctccgtaaaagctgaggtgaaaaaaggttatttgtgccaccagaattttagttttggagatttagaatcggaaggacgttgcattcttgcgatcatcgggtacgagcagattcagatttgacagtttttttttttgtgtgtggcagggttcggttttctggagtaggaaagggaggtagaggtggacgccagggttcagcgataccacctcaagaaagcaggcctattggaataggtaactgatcaaatatacaatgattagtagctaggctttcacaaacatgaaacgcagcggaaaaaacagactaacagaatggcaatgtgacgtccagcggaaatgaacagcagcggggagtacgatgctgcgttcgcagccacaattgcagcagcagcatttgcaatcgctgcccgtgaggataagctcgcggctcaaaagaactccgtccccatcgaggaggtgaccccttccctatcgccagtcaatagagctgaaggcaccaaaaagcctgcaggaggcaacaaaatcgcgagatggtttagcggcaaggagcctatagaacacgacgacgacgacgaggggccaggtagtgtaaacatgttctaccttaactcccattctttttgccacgtatactgtagcaaaacctgcagatctcttgtaacaatgctgaaacgaaatgaaatatcctttcagttaatgtatcggtaaggaggccactgaaaccagcacctggaaagcctgaggacgtgcctgcagatcatcacaaggtggcacccaggatgcttgagacttctctgggtgtgaggaagggttcgggatcttccagcaggtcggcagagaggaaatggagcaaggagtttgagcaagaacaggctgttcagaaagcgccctcggccgtgaggccagccacgtcataccgctctggacggaatggagaaggcgcggcaggagtagctgctactggcggcacgggatctaaggctgatgaatgggagaaggcaaagcttggaagagttagagaggagtgagtacgatctattttttttattattctgaaggtcactcgattgaagctatgctgatatggagttatggacttcaaatttaggtatgagaagatgatggagaccatagccgaatgggaaactgagaagaaggtgaaggcgagacgccaaaaagagcagaaagaggttttagtttcgttaattcattcgtagtttaaagaacactgctactgcactattaattcagtatttccttcgtcgaaagcatccgtagtacaagccccaaaccctaaaaaatggtatcgctaggaattcgtcatgacaacttatttgattaaatcacattgtttgaggatactcagagccgagcttcttaactttgcagaccgagctggacagaaagagagaaaaggcactagaagaatacaacctggagatgacaaggatcagcaaaatctctggaggagcaagggcgatggcggaggagcgaaaatacaacgataggaaaaagatcagagagaaggcgcgcaagatgcgatccacaggaaagcctccccgcacgtgtgcttgcttttgagaacagctgcatacgctgaaatttggaaccaaaaccaaatgaaggacgtcattttggacggttgtaaaaggcacgcaatagtgacgttctgtattgtaatatgtatttggctttgacaagttatgagtgcacattccactgaaggcaacatcaacatatttttgaagggtgtggagttaaggaataaaaaaaaagatccaccatgcatcaacattcaagatgaagcatggagtaggaactgccccaagaacaacgagaacgaaaacatatattcatcataaaggtcaagatttaggattcccattcaaggtataaggtgtgagactagtatcatccaattcaagtgctgaggttcttcttgagctttggccaccagacttctcagattcattcctatttttgttgattgttgtctcctcatcctgtgtaccagattcatctgattccacttaattcaaaatcatactcttcataaatttggttatccgatagttcttctggtgactgatgaggaataaatatccttgatttcagtccaccctgttctgaagtattttcatcaccaacaaaaacacttggtccagtcagcatggacttcagcttctcatgaagtccaccatctgatgaagtttctgaaactgattggcagtgagaagcaccgttgttcatcctactgtcaaaaactttaccagacgtatcattgtctgctgcatttctagaagcaaaatcaagacaagactcaggctcctcattatgttttttttgtcaagtaccagtaacctcggagatctttcaaaatcttcatgaactcccattccttccttacctttagagattagagactccacagatgcatgactccagcttgatcatgctcaattttttttattttacataaatagctaaaaattgactaaaatggtaaaaggggtactttttagtcacttttaggtctttgtgtttggacctttagcttctcaaataactaaacgtacttcgcattagctcactagatccaaacatgttctaaagagaaaaaatcacagcacaaggacagttgacagcacagaagaagggaatttactgtctgctgaagggaaccaaaggctccctacgttgtccctccaagcagaactattcagcaatcagcgtacgcccaaaccaccggcaacggcaacttaccctgttgctctagcagccggaaaatccgacttcgcatgtcttttctccacaacagcaacagcatgaggtagctggccttgcatcctttcactaattcacacttcgacgatcactacaggtaccagatagaagtggcagaatccagtttccactgactgcaacgccaagaacataagtagagagaaaatgaaaaatcatgcattgatgacaaaaacaaatgcagtagtacgtgtctgccgagcaacgcagcgcacagcagacgatgagaattcagacatgtactaggtgtgtgcc

SEQ ID NO: 626 - protein, 316 aa, Zea mays
MGVRFSGVGKGGRGGRQGSAIPPQESRPIGIAEMNSSGEYDAAFAATIAAAAFAIAAREDKLAAQKNSVPIEEVTPSLSPVNRAEGTKKPAGGNKIARWFSGKEPIEHDDDDEGPVNVSVRRPLKPAPGKPEDVPADHHKVAPRMLETSLGVRKGSGSSSRSAERKWSKEFEQEQAVQKAPSAVRPATSYRSGRNGEGAAGVAATGGTGSKADEWEKAKLGRVREEYEKMMETIAEWETEKKVKARRQKEQKETELDRKREKALEEYNLEMTRISKISGGARAMAEERKYNDRKKIREKARKMRSTGKPPRTCACF

SEQ ID NO: 627 - DNA, 5878 bp, Zea mays
tgttttttatcttcctttcgtcttaataaagatccatattacatttatatttactatgtcatatatatacctcactatctcgaagatacatctcgttgcggaagcataaggtagctttggaggtaaagcttagagcgacatgtgggtgcaacaaacaaacatgggggcacaacacacctcacctcatataactaatttggcttgcaaatcgagagtcccgtacgaaaagtactcgttgtctcttgacccaataaatcaaatacaccttcttacacaatttgtccattttatatttttcgtttccaataacaaactcaaagtgacttgtttttttggacctttgacacatagcctttaaagtagatttcacaatttaagcttgttatgtaaaacaaactaatttcgagagaggctgattgaggagaaagtctgcggtcgatgattcaattggacgaaatcgatgtttaaactgtcttgttgattaaatttctagcttcacacgtgcttgaacggcgtaggaagtgttggaatttcccttcttatgatttattagagtagagttttgttacagtttatttacggattcattacggtatttattagggatacgttgacatataacttcagtctttcttttttaatagtcacaagaaactttcacacacctactaggagtaacagaaaaacatggacatattgatttttgaaaaaagaaatattgacagataaggtgttggggaccgtagagactagagaggatgaggacgacgccaggcagacgagccttgccgattgccgtcgacgtcaccctggtcaggcgtcacttgacgacgtatacaggggcacagggctcaggttttccttcaaattgcgccgaaatactcgagatttcttggatttttttacttgtttattctattctccttccggcgcctctctagtctattctccttcctcgtcgagtcgtcgtcttcttcgatccactctttcccccatccctatctccctactttccacgcaactgcgtttcccccggactcttcttccacgattccgttggacccctaccgctcctcagtcagtcctcgcccctcccagcaccggccaacaatccctcacgttattccctgtagctactatgctgccctcttggatccctttttcacttgtctgagatttagccaccgcccggtaggaagaagaaggggaagcaccatattttctgttcctggcctgacgcagcgccggtgagatttcagtccgggatcggcaacgctgggaggactcgcgtgtgatttacgccgacttccgtgccgctctaggaagggtcacgtcgaggaggcttttgccgacgcggatttgcctggagccagccaagcagagcgcagaattgggggtgtttggccgtgcaaagccagaaagttctcggtttggctgccgaaaccgcttgaggcgaccaccatctcatggtcgtagtggtccgggtccggcacaagtaggggctcgcgtcttgcgcttggcagttgtgggaagccatggagccgtcgtcgtccatcacgttcgcgtcgtcgtcgtcgtacctgtccaacggctcgagcccctgttccgtcgcgctgccgccgccagggccgccccagactcccccgttgcctgccggccaggggtggggtggtggagtcgctgccgcagggagcggaggcagcgtggaggccgtgagcctgaaccggctcagcaaaaacctcgagcggctgctcctcgacccggacctagactgcagcgacgccgacgtcgatgtgcccgacggtgggccgcccgtacccatccaccgctgcatccttgccgcacgcagcgacttcttctacgacctcttcgccgctcgcggccgcgcaggggcagcgcgcggtgatgcggccgccggcgccggagtagccgcggagggggctgccagtggaaggccgcggtacaagatggaggatctcgttcccgccggccgcgtggggcgcgaggccttccaggcgtttctggggtacctgtacaccggcaagctccggccggcaccggtcgacgtggtgtcttgtgctgacccagtgtgccatcacgattcgtgcccgccggccatcaggtccgcggtcgagctcatgtacgcggcgtgtaccttcaagatccccgagctcacctcgctcttccaggtgagacgcaatttggttcttgctcgccccattgtcaataggattaaactctaatttctttaggaattgtttcgttctatgccaatactgtacatggcttcggtagactagaaatggatttgtgattttttttctccaatccgagtgttgactacatcactacaaaaagctatcaatagctgaactgctaaaattgctgattttgttttctccaatccgagtgttgaccacatcactgcaaaaagttattaatagctgaatcgctacaattgttcaattgttgattttgttttttccaatccgagtggtgacactacaaaaaactattaatagttgaactactaaaattgttggctattgcttttttagttgattcaagcgaacctggtggcttgaagtctatgaattgaaatggaatcattattcattaggctgctcaacatttgtatattacatttatggctgtataatttatcaatctgtttaacatcaattcagctttgctttgtcgatttatggaaggcaaatggttaacatggtcttcttctacagcgccggcttcttaattttgtagacaagactctagtggaggatgttattcctattctggaagttgcttcccactcagggctgactcaagtgatcgacaaatgtattcaaaggattgctagatcagatctcgacgatatatctttggataaggagctccctccagaagcagttgatgagataaaaaatttgcgcaagaagtcacaaactgctgatggtgatacgttcatttcggaccctgtgcatgagaaaagagtcagaagaatccacagggcacttgactctgatgatgttgagcttgtgaagttgcttcttaatgagtccgacatcacattagatgatgccaacgcattacactatgctgcttcttactgtgatcctaaagttgtctcagagctgttagatttggcaatggctaacttaaatttgaagaatagccgtgggtacacagcactccacttggctgctatgaggagagaaccagctataatcatgtgtctccttaacaaaggggcaaatgtgtcacaactgacagctgatggcaggagcgcaattggtatttgtcggaggttaacaagagcaaaagactacaatacaaagatggagcagggtcaagaatcaaataaagataggctgtgtatagatattctagagagggagatgatgcggaatcctatggcggtggaagatgccgtcacctcgcctttgttggcagatgatcttcacatgaagcttctctacctggaaaacagaggtgaagtccataccatgcttgatagaatggctctgattggttgcctgttgccgcttcaaattttgaaaatttaaaagcttggaggtcaggtggattgattcaggctagcttgtagactaatgacatgtgcctgaccttttgttctcataaagagggaaaaaggaaaacgcccaccccataccacatcaatttctcctttttttcaaattggtgaaagctgtacatgttgtaggaaataaacaattgtagtcacaaagcccaaattaatctaattacagatgacaagcctggattattaaattgccacttgcctgtccatattgcacacaacctagtagtgtcctagttctagataatataacgagaatgatttcacaccactggatgatgatcaaatagcaccttagaacttggggttgggatatgtcattgtcgtgagctttgtcttatgttcacgtttataagaagattgtgatttatgttattggctacattattttccctgcaccataacattctaagtattgttcctgcagttgcatttgctagattgttctttcctgctgaagccaaggtcgccatgcaaatcgcacaagcagacaccacagaagaattcggcggtatagttgcagttgcagcaagcacttctggtaaactgagggaggtggaccttaatgagacgccagtgacacaaaacaaaaggctccgttcaagggtagatgcactgatgaaaacaggtgaaagtttcaaccgtcaaccttttccattgtagtgaacatgccctgcagctatctccagaaaatttagttcggacgcaatcacggattctacgtgtacctgaagtattgtgactatgttcaaaatacatgattgatacaatgtatctgatctggtgttcgcccatttttatccgatgacttcttgcagtggagctgggccgtcggtacttcccgaactgctcgcaggtgctggacaagttcctggaggacgatctgccggaaggtctggaccagttctacctccagaggggcacagccgatgagcagaaggtgaagaggatgcgcttctgcgagctgaaagaggacgtgctgaaggcgtttagcaaggacaaggcggagggcagcgtgttctcgggcctgtcctcgtcgtcgtcgtgctcgccgccccagaagtatgcccagaggtgatcaaggcaccagtttttgccgtatagtttgttatcatggtcttcgagacttggacccggacagcatatagggacatgtacacctgtgtatgtatagtgcttacaattggcgtaagtagaactatatgtatggaacataaggaaacatggcaggaacaccgtgcaaaaagatgaaaagatggccgaagtgctctatgcgagtgcccacctgattcgatggccctattcaacggcgccctgtcagcatgctgcatgcccactgagaccttcggttgcatagggataggaggagatttctgttcaattttggctagcaagtgatataggggtgtttaggactgtttcactttatgaaaatcaacttagctcataaacacttttaacttcaataacttaggtcctgtttggagtggctgtatttttctagtcccaagaaaataatgtggtatctgagaataccatggtctagaaaccaaaatgtgtttggcagactcttttaaaccatggtatttaaaatcttggttttgacaagaccacattatttctgggtatagaatactgtccagactagggctggaaatgagccgagttcggctcggctcggtgcggctcgttgactgaacgagctcgactcggctcgtccattccacgagctggtgaaagaggctcggctcggctcgaccttagctcgcgagccatattcttgtacttatcgtttcattatttgatgaattaacattatataaatttgaaatataaaatcatcattctacattatgagtaaattaaactataacttgtaatatattcatcatcaaagactaaaaaataagctattatccataaaattatctaatatttattattattccataaattgatcatttttgcaaggctcgtgagctggaacgagccggctcggctcggctcgctgcaaaaacgagctcgaagaaggggctcggcttggctcgttcgaggctcgcgagctgcgccgagccgagccgctccgagctcgagccggctcgcgagcctcgagctaattttccagccctagtccagaccaaagtttttcgtcagagcgcgcgaagcgaccctaatgtccgcgcccttttctcaccgtccacgcatctcttcccctcaattctaaggctttctccaacaagaaacgttaaagcgttcggtacgctatatttagcgtgt

SEQ ID NO: 628 - protein, 621 aa, Zea mays
MEPSSSITFASSSSYLSNGSSPCSVALPPPGPPQTPPLPAGQGWGAGVAAAGSGGSVEAVSLNRLSKNLERLLLDPDLDCSDADVDVPDGGPPVPIHRCILAARSDFFYDLFAARGRAGAARGDAAAGAGVAAEGAASGRPRYKMEDLVPAGRVGREAFQAFLGYLYTGKLRPAPVDVVSCADPVCHHDSCPPAIRSAVELMYAACTFKIPELTSLFQRRLLNFVDKTLVEDVIPILEVASHSGLTQVIDKCIQRIARSDLDDISLDKELPPEAVDEIKNLRKKSQTADGDTFISDPVHEKRVRRIHRALDSDDVELVKLLLNESDITLDDANALHYAASYCDPKVVSELLDLAMANLNLKNSRGYTALHLAAMRREPAIIMCLLNKGANVSQLTADGSSAIGICRRLTRAKDYNTKMEQGQESNKDRLCIDILEREMMRNPMAVEDAVTSPLLADDLHMKLLYLENRVAFARLFFPAEAKVAMQIAQADTTEEFGGIVAVAASTSGKLREVDLNETPVTQNKRLRSRVDALMKTVELGRRYFPNCSQVLDKFLEDDLPEGLDQFYLQRGTADEQKVKRMRFCELKEDVLKAFSKDKAEGSVFSGLSSSSSCSPPQKYAQR

SEQ ID NO: 629 - DNA, 3255 bp, Zea mays
ataagtcgtcctagacaaagtttgagtcaaacttgtaaaactttgactacaaataggtgtttcattatgtagttttgaaacataatagtcatatgcaccgatttatctttaaaagtattttcacaaaagtataagtgtattgaaagttcatttgtattttaacaaaaaatttggactaaactatttttgtcgtgtcgttgtcctaatcgacttataatttagactttgatggagtatttgcaagtactgtaataatgtaatactccaaggcggtgactaagaaaaatccatggatgatctatactaagggcgtgttttgtcgtggctttgctccactacagagcagctctactccaaagctctaagtggaaaagctatactctagagtttaaatagctttctcataatctgtgacagtggtgagtaaataactccaaactccatgtatggatttctttttagagttttcggagtaggaaaagaggtactataaggccctatttgagatagttctagctttagaaatttggtggagttggtagaacaggtcattaggtgctctagaaaatcgtggagctatatataaatcattttgtttattatttagattaaaaatatttttaaaactatttaaattcatattataaattataattccacactagagctgaaacctgtagccattctaaacactccttaaaaatttatactacatctctcaaaactccatagagtttgtaactgtggagttcaggtgttggaatagatctgtccagctcctcattagagagttttgttttgaatccataccgaatacaccttagtcttaacttagaataaagagtggtggtaaaccggtagtggtagggggaaaaaaagagaagcgaggcattgactttgcacagcccagcaggcagctcgtcgtctagcatttggtcctctcgttcgcacctccgccatttctacctataaaactcaccctccacctgtttcccacctcacaatcccacaacccaagaagccacaagaaagcagcagcagcaccgcacggacctgacctccaactacaagcgacgatccaggctccagagccccacgcaaggccggaaggagacaggcagcagcccggcagagcagctaagccatggcggtggacctcatgtcctgcggcggcggggcgtacgagcaactggcgttccaggaggcagccgcggcggggctccgcagcctggagttgctcgcttcctcgctctccccgtgcggcgcggggcgggcggagtcgccgccgctcgggcagatcgccgaccaggcggtgtcccggttccggcgcgtcatcaacctgctggaccgcacggggcacgcccgcttccgccgcgcgcccgccgtcgccgcggtggagcccatagagacggagacgccagcgtcacagcaggcggcggcggagccgcctcatcaggctcagaacaaagccctgacgctggacttcgccaagtctgtcccgccggcagcgaacaagaaggccccgcgggcgccggccgtgtccgcgacttcgacctcgttcctgtcgtccgtgaccgcgggcggcgaagggagcgtgtccaaggggtgcagcctcgccgccgtgtcctcgggcaagccgcctctcccgaagcgcacgtcgccgtgccccgccgctgctccgccgggggcgcaccacgccgagtccggcgctggaggttgccactgctcgaagaagaagcgcagccggcagggcctgtcccggcgcacggtgcgcctacccgcggccgcggcaacgccggggtcgcagccgcccggccacgtgccggcgtcgtcggacgtaccccacgacgagtactcgtggcgcaagtacgggcagaagcccatcaaggggtccccttacccgcgcggctactaccggtgcagcagcgccaagggttgccccgcgcggaagcacgtggagcgcgccgccgacgacccggccgtgctcgtcgtcacctacgagggcgaccaccgccacgacggcgacggcgacggcgacggcggcgttggcgctggcgctgcccgctcccgcgcggcgtgaagatcgtttgcttcccgccgtagcagtcagtgtagcagcggtagtcaagtcaatcgatactagtagtagacctcttgtttcatttgttcttcggattagtggtagatcgagctttgctcctgtaaaaggaattaaagagcatttaaacttaatctcgccatgaactttctccaaatctacgtattattttatcttctatgcataagcgtcaatttctcggggattatatatatatataataattgtaggaaatatgatacacacagatggaatttgggtggtgatttgaagtggtcgcagcaggttcctttggctctcaactctcaagtcaaagaaacggacagggcatgggcacggcatcaatacgcgctttaaagtatcgtgtcgggtttgggtgcatggggcccatgaccacaaagccggtcaaaagcagtcgatgagcggtcgctttcgcgttcagggacggttggcccgtttggggctgtgccgttgggatatccgtgccgctgtggcctgttgttgtgtccaagagttgactggacagcgaagaccccgtcctcactccccagaagagcgcgtgcaaaccaaggacgacgcgtggacccactgtcggacagcgtaacggggtctccttcttgttcaacggcacagccattggtggcgcctggcatagcgtttctcccgtccgtttttattttccacgcgttgacttttggatcagctggttgtagccgaagttgctactaggtaagtacaaagcggtgcttgtctgaccagcatgtcttgctcgcctcgccaagcaaggttaggcttaccagcgccggagggcagttttgcctggctcgcgttggcaaccagaaactttgatactgtatccatgtttaaagaaagagaaatcgaactcgctccattccaaattaaaatatgttttagttaattgatagggttcatataatacttgatataatacttgatgtatgtgttatacatatatgtctaggttcattttcatctatttgaatctagacataaaaactgataagagctacaacgactagcaaggagtatattgtatgaggtgtggagaactagcaaggacatcgttgtggacctctacgtacaaactattgagcactagatttggcatctatacacgatgggatggtatagccatg

SEQ ID NO: 630 - protein, 311 aa, Zea mays
MAVDLMSCGGGAYEQLAFQEAAAAGLRSLELLASSLSPCGAGRAESPPLGQIADQAVSRFRRVINLLDRTGHARFRRAPAVAAVEPIETETPASQQAAAEPPHQAQNKALTLDFAKSVPPAANKKAPRAPAVSATSTSFLSSVTAGGEGSVSKGCSLAAVSSGKPPLPKRTSPCPAAAPPGAHHAESGAGGCHCSKKKRSRQGLSRRTVRLPAAAATPGSQPPGHVPASSDVPHDEYSWRKYGQKPIKGSPYPRGYYRCSSAKGCPARKHVERAADDPAVLVVTYEGDHRHDGDGDGDGGVGAGAARSRAA

SEQ ID NO: 631 - DNA, 30082 bp, Zea mays
catctcaaattctaaattgactgtccgaaataccatagattattccaagcaggagaagcttttggaaaattcacctgtgcgcggaccgttcacgacacctcggtgagcgttggacaagaactatgcaaaactcacatttctactatggactgtccgaaagtgagaagaacactgtccgggatcaagcttagaccgtctggccattgaaaaccagagaaacccgaaggtgacgggttcagtaaaatacatttttagcgtcttcggagactgttcggggtgcacgaccggaccgtgcgcgactgctttatctgatatctaacgacatatttaatgtatttatagccgttgatatagccgttactgctgatcattgcgatttcagtcattgatgtgcagtggtggaccgtctgggccaggagcgcgtaccgtccacggttggcagaaagtgggcaacgactagaaagtggttggtggctataaatacaaccacaaccacctccattcacattattctagcatctcattcattctcattcaatacaaaatcaagcacttcattccaagacacattcaaatcaaatgtgaatggataagtctctgatgtatgtttgcaaggatagcatatcaacaagaattatcatcataacttaatagattgataacaaagttcctccaaaaaaatctttgtatcctatgcacaacacataagagaacaaaacgtcattttttattacgtatttatatggttctatgtctatgtttaatcatggattttgatgtactcacgagtcacatcgcccgtcgatagggccctaagtcgttggagactcgtcaatttatgttctgtgacatcgtacgagcacatacctaataagaaattaaagttacagtgaaaggaccatcttgtccttcaaaccctagctagtttttcctatataaaccctggggggcgtacatatatatcacgcatcaaactagtagcaaattaataatccagcgaacacactatactagtgagcaaataaagccaccgatgtcatcactcctgttgcgagtgctgctcatccagcttgcagcagtggagtgcctctccgccgcgattccaggctgcctaacgcaatgtggaggcgtagagataccctatccattcggcgtcggcaccaactgctcccgcaaagggttccggatcaagtgcatcaacggcagcgcgggcgaggagattccagtgctgctacctactacgcgctaccagaacatccgggtgctgaacctgtccgtgtcgccgttgccggaggctcgagtgcttcttccggtggcatggcagtgcttcaacgccaccgggggcgtcactgggatctactcgggagatgtggacttcaacccagagggcgtataccgcatctccaacacacagaacgagctcttcgtcctcggctgcgacacctatgcgttcaccaaaggcgtgagggtgcacaacgttaacgcacgcttcccttacagatacttcacggggtgtatcaccgtcagtgtagacgacaaggacccgcgcgacggtgcctgcgcgggcctcggctgctgccgcgtcgacatcccgccaggcatcacggacaccagcatgaccttctcgtctacctggacgcgtgccaaccagaccttctgcccctgcgactacgccttcatcgtggagaagggcaactacaccttcaaggcatccgaccttgtgtcgcacacacccgacaaccgtctgcctttggactggtggaccatgccactgcgtctcgactgggccatccgcgacaacaacggcgactccatgacttccatctcctgcgcccaggcacccaacgaacctgactatggctgccgcagcaagcatagcgagtgcactaattcaaccaatggccctggctacttctgcaagtgtgcccatggctacgacggaaacccctatgtccagagtgatggtgaatgcacgagtaagtagtatatataatccccttcttctcaatctataagtggttttatttggttattttaaatacatcacttttattattaactatatgtatcccgatatatatatctacctcattgcaattttgcccgtaccttgtttgtgatggcaaatgtcctaatcacttctatatgtctttcagatgtaatttttctatcctttcatgctatcgtcagtggcacaaaaggataagtacatgtgattttcttacccttttacgccactgacgagggcatgaaaaaggtaagaaattgcatccgagtgacatagaagagattaggatgtactggacaaaattgcggtgacatacgtagaattttctctatatatctagtaatgcatctagaaaaactaaattggcattatttggagcaggactggtgtatattctcaaggcacggtgccatactatactcattatttaatatataccatgtaggatagaaagctgatgtgacatttgagtaaagaaggaagaaaataaaacaatatcttgagggagatgccacttagacacgagatcataggcattgaaacctaaaacaactaaatgaccacaattcattctctcatacacaattatcgttaaattgtcttatgtgtggcactatcggaattcgcctttttgccgggtgccaaatattttgccgagtgttttctttcaggcactcgtcaaagaagttttttaccgagtgccagacaaaaaagcctcggtaaataaaacactaggcaaacaagatctttgtcgagtgttttatttttgacactcggcaaagacaatttaaaatcatattttaaagcagtaaattaattcaaatgaaaaaattttaactacaaatttgtataactcatcatgatgtacaatttatattttgaacatttcttcatatgacaaaatataagtaaatttattcataaaatctatatctctctcgtagtttataaaactacgagagagatgtattagatttgtgcatattgttagaaccatcatgtgagattaacaagtgaccaaaccaccgaaataaactttgtagatcttgagaagttatagaagtttatagttggcaactttttcatttgaagtcatcttgtcaactaaaactacgtctgaattttaaaaatttaaaatttgaattttgaaaacgacctcgaaaaaaaaccaccaacatgaaaattgtaggtattgaagggttatgaaactttgtagttgacaatattttggtttgaaatcatcttgtcatgcaaaactatgattgaattttaaaatttgaatttttgaaactacctcgaatggaaaaaccaccaaaataaaagttgtaggtcttgaaatataataaaactttgtaattgacaaattttttattttaaatcatcttaccatttaaaatttcgtgtgaagttttaaaatttgaaattaaagttttgtaaacaatctcgtatgtagaaactatcaaaatagaacttgtagatcttgaaaagttatacaactttatagttgttcacattttcaaatgaattcatttagtgtctcaaataatcagattattctcgggttgttatagtacatgggaatgaaaacgtaatatagacataattgatgtagtagtgtagtgcgcgagagaggttgcaagttcgaatctcactattcataaaacatgtaaattttattcaaaataatagtgaaaaatgataggataatggggtatggtattgggtagtggttggagagttgttcatataatttagaaaatgttttgctattttttggggttttttttgcgattcctaatttaccgagtgtttttcgacactcgacaaagtctttgttgagtgtccgaaaaaatatactcgacaaaaaacccttcaccgataaaatatttgtcaagtgtaaaatggcctttgccgagccgagtgtcttagacactcggcaaagaacgtgagtccggtagtatggactatgaaacaacgtatggtaatatacacgggataactatatagaatcttcaataataacatatgagacgacaactttgaatactttgacaagaaatagtggtttggaaatgggctaagccatccagtcggtgagagggcacaagttgtcggactagtgtcgttgataataacggagatagttggtctgatgtcactgtccagaaatccatatgatcatggaattattatcaacgacaaatttgtatggccacacatcacatccatacagattcctttgtctacttcctattcgttgacaagaaattgtgatagcactcgcattattgttatgtcccgtttagatcattggaattgaattccattctaataacagtaattaggtatatactaattaactaattcgattttatgcaaaatatatttgtatactgttattaacaaggtatcggagatatttatatgtgctacatttttactatcgagaagtgagttgaaaatcgtcttgtaagttagagagtcgaaacaaattctattgatacataaaatcatttccaatcttccatctcatgaatttgagatagacttatatctgaaccttaaaaagtggtagaatgttaaattccaaggtaaatgtgttactttattgactgaattccagttccactaaaatgaaggtatatatccaaacgcacaaaagcgacaaagtagcaatgacttcaaccttttaaaaaaaggtgcctttaaaaaaacaaaagagcaggaatctgtttattaagattaattttccgaaccgtgtgttgaattcttttgagttctcacatctcaaaagatcgctccttgctttcataaattattggcaaacgactgactctcttttgtgactatttgaatgctcacaaaattaataattaattatatacagatatcaacgagtgccaagatccaaagtcacataattgttcaagtggcagcaaatgcattgacacagacggaggctattattgtcaatgcaatttcttccgaagagggcagcaatgtgatcccttaattcctatggctgccgttgcactgttaagtaagcacaaaattctattaacaccttgttacattacatcattctctttaatttgcacttagcttgttctgtttcgtcctaaaagtgactaaaacgacaaaacttttgcaccattttagtcatttttagctctttgtatttggacctttagctaccgggataaagtggccaagggagaaaaatgtaaggctatgagtcgccttgagttgtgatttgcgacaacacgggcgtgagcctatctagcgactagcgaggtttctccatgatttttttggtgatgttagcctggtttataatttaaaaaaatcatttatagtggtagttttattaataaaactgctattattgtaaacctagtgtctgagaatgtaaatatttatagtggcggttttttaccaatgtctggccttgcacacgtacgggcggttaaagaaaccatcaataagggctagtttgagaactccattttctcatggaatttctatttttccattgtaaaatgaactaatttcctttggaaaaatgaaaatccattggaaaaattaggtttccaaactagccctaaagatcagttttctaccgtaggtaaaagtcttttgtgtagtgtcctgataatttcttaaacattcaattacacaaatagaagaactaatagcgtgtttggtttgaggattgagctagtctatcatcttctcactcctcgatatttatgtttggcttgtagaatggaatgagttgatccatcattacctcattcctcatagttagttagttagtactaatgtgaggaatagggtcatcccaccaaatttgtgtaatgaacctatgatgcatcacctcaatttggatacagtgattccttaaaccaaacaccccctaagagcgttgcctaggccttaaaaaattctaaaaatgaataaaagaaacaagaatcattatgattttgagttagcaaaaaaaaagatagcagcaaccgactagatcaaaatttgaaaaactcaaatatagattcacggggatagatatgcaataagattcatgctatgttctgttagttgaatggttgaacatgcatgtatctttctcgaattctgtctgcagcaacatttgctgccgtcgtccttggatgtgtcgcaattgttttgcttcagactctaaacaacaggaaaagattcaacagaaatggaggtaaactactgaatgcccagggcataaccacctacaccaaaagggagctgaagaagataactaatggctacagcaaacgccttggaggagggcactttggcaatgtttacgagggcaccatcgtcgacggcagaaaggtcgccgtcaaatgtcctttgcggacaagggtgtcgtcgcaccgctgccattggaagaatttgattcgacctcgccgtgtaccgctaccgcaacagagggtggaggaagatgggtcgttcatgaacgagatcaggttccagttcgaagtcagtcgtcacaagaacttggtccagctcctgggatgctgcctagagaccgacattccgatcctagtcttcgagtttgtcgccaatggaagcctggaggacatacttcatagtgccaagaaaccatgtaccctctcgctgccggagcggctggacatcgccattggctccgcggaagctatcgcctacatgcactcccttgacaatcaaaagcgtgtccatggagacatcaagccttccaacatcctccttgacgatgacctcaatccaaaagtctctgactttggttcctccaagctcctggcaatccatagctactacgttagggcagtggctgcagatataggctacatggacccattatatatgaagaccgagcacttcacattggagtgcgatgtctacagcttcggcgtggtgcttctggagctcatcacgaggagaagggccagctggtatgaacaagatcaccaagggaacaagatcctccccatcgagttcgtcaagtgcttcaaggaccacggtagcggatgtgcgatgtatgatagcagacttgatttctcagctggcgaggatgctcaatctcgatgcaacaagcgttgcctcgacatgattggcatgttggccgtccgatgcctcaaggaagacaagagggagaggccaaccatggcagaggttgtcgaggagcttaagcgagtgaaggtactactgctgggtacacatatataaaataatggcctgcagcaatcaagcgagttcgaagcacgcagatgaatggaagcgaagcaagcaataagaatggtcggtcagcacatgtgaagcgctgaacatggcggcggtactgatacaagcaataataagggttcctcaactcaaataaatatacatgatttattctcttccaataaaacagcaatgtctatctgtaaacatagtaattcgcatgaattgcttcgctttatacttcttaatttgatgtatgtccatacaaataattgacactatatatcgagcaccaaaagtgacggacactatatatcgagcaccaaaagtgacggacggtccggccttagagcccgaacggtccgcggccccgcgattagatcaactcagttgatcatccttatctcgtgcgtggtgatctatctaatcacgtgtgagttgttagctatcttctaggaacaagtccatacctcctctactataaatataaagaagtatatctccgcaatcagatcaactcacgaccgattgagaacccacgaacacattccaatcgaatatatctactttatttacctttcttctcttaggagtagatgtagcgtacttctagtttatagccttccgcatatccacctccacctctattcgactctacgtcgtctagatccatcttgggtggtctgccgaccctaggatcttacccctcccggggggcaaaatctagttgttcattcaaaatactatatctcgactgcctcttaatttttagacaactccacgtcgtcttgggacgccccgagtgacctgtcgacccggagcgtcctaagatctctcccccaggtgcgagatctagattccagcgaggagcaagacgaccctgcgccatcgcgtactgtccggccctgtgcgcggaccgttcggtgcaacgcatggaagacgtcgctcctgcaccgaggtcgcgaaccgtccggcccagagccgtaggctgttcgcgtctccgcagagagcaccgccaggcggtacacccctagtgattggcgcagcctagatcggcgtcaacagacacattacatacgtgtgtacgggtaggcatattcttgagtactaggataagtattttattcattccacacacacgtgtaggcatcaccatgcggtattcaagctcttgtatattaactagtcttaaaatagccccattttctagcgtagcgcaatgtacacatgcacatgcatgtttctagataaaactccagcataaatcttgtttttttttctaatttcagttttccgattaaattcgaatttggtttgaaattcactcacacaatttgaaatgctcaagcaaataaaacttgagcatcagatgcaaggttatttatatttatttattattttatccgtttagatgaatgcttctaaacacgtaattcataaaacaacaattaccttaattaaagaagggaaaatctttctattcatttcaaaaacccaaattctagttttttccatattttagagaatattctaaatatattattcaacaaagaaatgattttactcacataaggaccttttcatttaactttataattcattttgtcaattgatttataaaaagaaaatacttaaaactataattcgtgattctaaactactcaaatctcactgaataattaaactagatcttgataaattttgttgatttaaaaactagggtgttacgtttcttttgccgtgttccacttttagatgtcatatgcaccttagacacatgtaagcatgaaccccttttatatgtatatataggtcaatctttttttagataatggaacaaaaataaggtcccaacctctacgccatccaagacagcgtacacagcgtatcgatacatccaaaaagcgcttaggctcacaaacagactcataaacctagtttaccaaagacagctagacgactaggccgcaattctatttgagaacttccacccaaacttagcgaacacctccataacgaccgactccaataagcggcatgccttgttcagatcgatcctcgcgtcctcgtctctaagcagcagcgaccaagaacgtgcccaatatgtcgccctgaaaataacctgcatgaaagtgttagccttggcgcaattaaacaccatatcatttctattcaaccatatagcccaacaaatagcagataaacctacacaaatctgatttctaaatgctggccgaataccagcaagccaagaaccaaacatgtcggagatgctagagggaggttgaattccaaaggtgatatgtattgtattccaaataaagcgggcgaagtgacattggatgaaaagatgttcaatagtgaaagtcgcctagaggggggtgaatagggcgaatctaaaatttacaaacttaagcacaacttcaagcggggttagcgttagaaatagaaacgagtccgagagagagggcgcaaaacaaatcgtgagcgaataaagagcgagacacgatgatttgttttaccgaggttcggttcttgcaaacctactccccgttgaggtggtcacgaagaccgggtctctttcaaccctttccctctctcaaactatcacttagaccgagtgagcttctcttctcaatcaaacggaacactaagttcccgcaaggaccaccacacaattggtgtctcttgccttggttacaattgagtttgatcacaagaatgaaggaagaaaagaagtgatccaagcgcaagagctcaaatgaacacgacatcactctctctaatcactaaagctttgtgtggagttgggagaggatttgatctctttgatgtgtcttgtattgaatgctagctcttgtaagttgtagaagagtggaaaacttggatgccattgaatgtgggtggttggggtatttatagccccaaccaccaaaaatggtcgttggaagtgtgctgtcgcatggcgcaccggacagtccggtgcgccaccagacactgtccggtgcgccagccacgtcagcagactgttggggttcgaccgttggagctctgacttgtggggtctctgggctgtccggtggtgcaccggacaggtcctgtagactgtctggtgcgccaactgcgcgtgctctgactctggcgcgcactgtagcgcattaaatgcggttgcagacgaccattgcgcgcgaagtagtcgttgctccgctggcacaccggacagtctggtgtgcaccggacactgtccagtgactcaccggacagtccggtgaattatagcgtagtgccctctgaatttcccgaaggtgaagagttcagcctcgagtgccctggtgcaccggacactgtccggtggcacaccggacagtccggtgccccagaccagggtgcctttgggttgtcttttgctctctttgtttgacccctttcttggtctttttattggcttattgtgaacctttggcacctgtagaactagtagactagagcaaactagttagtccaataatttgtgttgggcaattcaaccaccaaaatcaattaggaaaaaggtgtaagcctaattccctttcaatctccccctttttggtgattgatgctaacacaaaccaaagcaaatatataagtgcataattaactagtttgcataaatgtaagtgcaaaggttacttagaattgagccaatattaattcacataagatatgcaaggattgtttctttatatttttaacattttggaccacgcttgcaccacatgtttcgtttttgcaaattcttttgtaagttcttttgcaaatagtcaaaagtaaatgaataagattttgagaagcattttcaagatttgaaattttctcccctgtttcaaatgcgttccctttgactaaacaaaactccccttcaataaaattctcctcttagtgttcaagagggttttaatacaccaattttgaaaatactactttctcccccttttgaacacaatgagataccaatttgaaaatcttaaaattaggtggtggtgcggtccttttgctttgggctaatactttctccccctttggcatgaatcgccaaaaacggatacttgagtgaaatataagccctcggtaaactactttctccccctttggtaaacaaaatatgagtgaagattataccaaagttggagagttgcgcggagcgacggcgaaggatgagttgatggagtggagtggaagcctttgtcttcgccgaaggctccaattcccttttaatacacctatgacttggtttgaaatatacttgaaaacacattagtcatagcatataaaagagacatgatcaaaggtatattaatgagctatgtgtgcaaaacatcaaaagaaattcctagaatcaagaatatttagctcatgcctaagtttgttaaaagtttgttcatctagtggcttggtaaagatatcggctaattgttctttagtgttaatgtaatcaatctcgatatcccctttttgttggtatcccttaagaaatgataccgaatggctatgtgtttagtgcggctgtgctcaacgggattatccgccatgcggattgcactctcattatcacatagaagaggaactttggttaatttgaaaccatagtccctaagggtttgcctcatccaaagcaattgcgcgcaacaatgacctgcggcaatatactcggctttggcggtagaaagagctacggaattttgcttctttgaagcccaagacaccaaggatcttcccaagaactggcaagtcctcgatgtgctctttctattaattttacaccccgcccaatcggcatccgaataaccaattaaatcaaatgtggatccccgagggtaccaaagcccaaacttaggagtattaactaaatatctcaagattcattttacggtcgtaaggtgagcttccttagggtcggcttggaatcttgcacacatgcatacgaaaagcataatattcggtcgagatgcacataagtagagtaaagaacctatcatcgaccggtataccttttgatctacggatttacacccgtgtcgaggtcgagatgcccatcggttcccatgggtgtcttgatgggcttggcatccttcatcccaaacttgtttagaatgtcttgagtatacttcgtttggctaatgaaggtgccctcttggagttgcttcacttgaaatcccaagaagtacttcaactcccccatcatcgacatctcaaatttttgtgtcatgatcctactaaattcctcacatgtagattcgttagtagacccaaatatgatatcatcaacataaatttggcatacaaacaaatcattgtcaagagttttagtaaatagagtaggatcggctttttcgactttgaagccattagtgataagaaaatctcttagacattcatattggggcttgcttgagcccataaagcgccttagagagtttgtaaacatagttaggatactcactatcttcaaagccaggaggttgctcaacatagacctcttccttgataggtccattgaggaaggcactttttatgtccatttgataaagcttaaagccatggtaagtagcataggcaagtaatatgcgaattgattcaagcctagctacgggtgcataggtttcaccgaaatccaaaccttcgacttgtgagtatcccttggccacaagtcgggatttattccttgtcaccacaccatgctcatcctgcttgttgcgaaagacccacttggttcctacaacattttgattaggacgtggaactaaatgccatacctcattcctagtgaagttgttgagctcctcttgcatcgccaccacccaatccaaatcttgtagtgcttcctctaccctgtgtggctcaatagaggaaacaaaagagtaatgctcacaaaaatgtgcaacacgagatctagtggtaacccccttatgaatgtcgccgagaatggtgtcgacggggtgatctcgttggattgcttggtggactcttgggtgtggcggtcttggttcttcatcctcctcatcttgatcatgggcatctcccccttgatcattgctctcctcttgaggtggctcaactccttgatcttcaccttcatcattttgagcctcatcctcatcttgagttggtggagatgcttgcatggaggaggatggttgatcttgtgcatttggaggctcttcggatttcttaggacacacatccccaatggacatgttccttaacgcgacgcacggagcctcttcatctcctatctcatcaagatcaacttgctctacttgagagccgttagtctcatcaaacacaacgtcacaagaaacttcaactagtcctgaggacttgttaaagactctatatgcccttgtgtttgaatcatatcctagtaaaaagccttctacagtattaggagcaaatttagatttcctacatcttttaacaagaataaagcatttgctaccaaagactctaaaatatgaaatattgggctttttaccggttaggagttcgtatgatgtcttcttgaggattcggtgtagatacaaccggttgatggcgtagcaggcggtgttgaccgcctcggcccaaaaccgatccaaagtcttgtactcatcaagcatggttcttgctatgtccaatagagtttgattcttcctctccactacaccattttgttgtggcgtgtagggagaagagaactcatgcttgatgccctcctcgtcaaggaagccttcaatttgagagttcttgaactccgtcccgttgtcgcttctaattttcttgatccttaagccggactcattttgagcccgtctcaagaatccctttaaggtctcttgggtatgagatttttcatgtaaaaagaatacccaagtgaagcgagaataatcatccacaataactagacagtacttactcccgccgatgcttatataagcaatcgggtcgaataggtccatgtgtaggagctcgagtggtctgtcagtcgtcataatgttcttgtgtggatggtgtactccaacttgcttccctgcctgacatgcgctacaaatcctgtctttctcaaaatgaacatttgttagtcccaaaatgtgttctccctttagaagcttgtgaagattcttcattccaacatgtgctagtcggcgatgccagagccaacccatgttagttttagcaattaagcaagtatcgagttcagctctatcaaaatctactaagtacagctgaccctctaacactcccttaaatgctattgaatcatcacttcttctaaagacagtaacacctacatccgtaaaaagacagttgtagcccatcttacataattgagaaacggaaagcaaattgaaatctaaagaatctacaagaaaaacattggaaatggaatggtcaggagatataacaattttacccaatcctttgaccaaaccttggtttccatccccgaaagtgatagctcgttggggatcttggtttttctcgtaggaggagaacatcttcttctcccctgtcatgtggtttgtgcacccgctatcgatgatccagcttgagcctccggatgcataaacctacaaaacaagtttagttcttgattttaggtacccaaatggttttgggtcctttggaattagatacaagaactttgggtatccaaacacaagtccttgatcccttgtgtttgcccccaacatacttggcaactaccttgccggatttgttagttaaaacataagatgcatcaaaaaatttaaatgaaatgtcatgatcatttgatgcagttggagttttcttcttaggcaattttgcacaggttgattgcctagaactagatgtctcacccttatacataaaagcatgattagggccagagtgagacttcctagaatgaattctcctaattttactctcgggataaccggcagggtacaaaatgtaaccctcgttatcctgaggcatgggagccttgcccttaacaaagctagacaatcttttaggaggggcactaagtttggcattgtctcccttttggaagccaatgccatccttgatgccagggcatctcccactatagagcatgcttctagcaaatttaaattttttattttctaagtcatgctcattgatcttagcattaagttgagctatgtgatcattttgttctttaattaaagctaggtgatcatggatagcatcaacattaatgtctctacatctagtacaaatggaagtatgctcaacggtagatgtagagggtttgcaagattttaattctacaaccttagcatgtaatatatcattttcacttctaaggttagaaatagtgacactgcaaacatcaaaatctttagccttagcaatcaatttttcattttcatttctaaggctagcaagagagatattcaattcttcaatcttagcaagcaaatcagcattatcatttctaagattgggaattgaaacatcacagacatttgaatcaaccttagcaattaaattagcattctcatttctaaggttggtaataacatcatggcaagtgcttagctcactagataatttttcacatttttctacttctagagcgtaagcatttttaaccttaacatgcttcttattttccttaattaggaagtcctcttgggtgtccaagagttcatccttttcatggatagcactaattaattcatttaatttttccttttgttgcatgtttaggttggcaaaaagaatgcgcaagttatcctcctcatcactacaattatcctcatcactagaggtttcatatttagtggaggatcttgattttaccttcttctttttgccgtcctttgccatgaggcacttgtggctgacgttggggaagagaagacccttggtgatggcgatgtttgcggcgtcctcgtcggaggaggagtcggtggagttctcgtcggagtcccattcccggcaaacatgggcatcgccgcccttcttgtagtacttctcctttcttctccccttcttatcgtcgcccctgtcactatcactagataacggacatttagcaatgaaatgaccgggcttaccacacttgtagcatactttcttggagcggggcttgtaatccttccccctcctttgcttgaggatttggcggaagctcttgatgatgagcgtcatttcctcgttgttgagcttggaggcgtcgatgggtgttctacttgatgtagattcctccttcttttcttccgtcgccttgaatgcgaccggttgtgcttcggacgtggaggggccatcaagctcgttgattttctttgagcctttgatcattagctcaaagcttacaaaattccctattacttcctcgtgagtcattagtgtatatctaggattaccacgaattaattgaacttgagtagggttaaggaaaacaagtgatctaagaataaccttaaccatttcgtggtcatcccattttttgctcccgaggttgtgcacttggttcaccaaagttttgagccggttgtacatgtcttgtggctcctccacttggcgaagtcggaagcgaccgagctcccctcgatcgtctcccgcttggtgatcttggtcacctcgtctccttcgtgcgcggtctttagcacgtcccaaatctcctttgcgctcttcaacccttgcaccttattatactcctctcgacttagagaggcgaggagtatagtggtggcttgggagttgaagtgcacaatttgggccacttcgtcctcatcatagtcttcatcccctacggatggtacatatacaccaaactcaacaacatcccatatacttttgtggagtgaggttaggtgatatctcatcatatcactccacctagcataatcttcaccatcaaacgttggtggtttgcccaatgggacggaaagtaatggcgtatgtttaggaatgcgagggtagcgtagggggatcttactaaacttcttgcgctcatggcgcttagaagttacagacggcgtgtcggagccggaggtggatggcgacgaggagtcggtctcgtagtagaccaccttcctcatcttcttcttcttgtcgccgctccgacgcgacttgtgcgaaggggattccttttccttccccttgttgcgggactctcccgatggagctttcccatggcttgtagcgggcttctcgccggtcatcatctccttcttggcgtgatctcccgacatcacttcgagcggttaggctctaatgaagcaccgggttttgataccaattgaaagtcgcctagagggggggtgaatagggcgaatctgaaatttacaaacttaagcacaacttcaagccgggttagcgttagaaatagaaacgagtccgagagagagagagggcgcaaaacaaatcgtgagcgaataaagagcgagacacgatgatttgttttaccgaggttcggttcttgcaaacctactccccgttgaggtggtcatgaagaccggatctctttcaaccctttccctctctcaaacagtcacttagaccgagtgagcttctcttctcaatcaaacggaacactaagttcccgcaaggaccaccacacaattggtgtctcttgccttggttacaattgagtttgatcacaagaatgaaggaagaaaagaagcgatccaagcgcaagagctcaaatgaacatgacaaatcactctctctaatcactaaagctttgtgtggagttgggagaggatttgatctctttggtgtgtcttgtattgaatgctagctcttgtaagttgtagaagagtggaaaacttggatgccattgaatgtggggtggttggggtatttatagccccaaccaccaaaaatggccgttggaagtgtgttgtcccatggcgcaccggacagtccggtgcgctaccggacactgtccggtgcgccagccacgtcagcagaccgttggggttcgaccgttggagctctgacttgtggggcctctaggctatccggtggtgcaccggacaggtcttgtagactgtccggtgcgccaactgcgcgtgctctgactctggcgcgcactgtagtgcattaaatgcggttgcagacgaccgttgcgcgcgaagtagtcgttgttccgctggcacaccggacagtccggtgaattatagcggagtgccctctgaatttcccgaaggtgaagagttcagcctcgagtgccctggtgcaccggacactgtccggtggcacaccggacactgtccggtgccccagaccagggtgcatttgggttgtcttttgctctctttgtttgacccctttcttggtcttattgtgaacctttggcacctgtagaacttatagactagagcaaactagttagtccaataatttgtgttgggcaattcaaccaccaaaatcaattaggaaaaggtgtaagcctaattccctttcaattagtctctagagaactacacgaacaacagcttagatttcctttccaattccgttttgcaaggttatccttagtgagagtaactccattttttatgtaccacaggaaaattttaattttaagtggtatcttaatcttctagattgggtacttacgtggaacaataccatcacaaatcaataccctatagagagagcgtgttgagaataccccgcttttgtgtaaattctaaatgaaaatgtccctatcagatgtaaggctagtgttgaggacacatgccaccaatttgtaccatgactccaagttaatgcccgttaacgcccttcgaaaggtcacatttagcggcgtggtgcttagcacctcggcaaccgttgcggactttttgcgcacaatctgatagaggttgggataggcgattttaagacgcctatcaccaacccagttgtcctcccataatctagtttcctttccattatgaactttgaaacgtccgtaatgtaagaattggtctttcactttcatgagtccagaccagaaatgggaatctccgggttgtctttgagcttgggaaaggtttttatgtgacaaatatttccttcttagaagattttaccaaatgccttcctcattaattaacttaaagagccacttactcaaaagacatttgttttgggtttccaaattctggatgcctaaacccccacagtctataggcctacacaagatgctccacttagtgagcctgtacttcttcttgtgttcatcacattgccaataaaaacgtgagcgatagtagttgagttttttaagcacaccttttggtatctcaaagaaagacaacatatacatggcaaggctagtaagcacagaattaatcagaactagcctaccacctactgacaacaattttcctttccaactactgagttttttctgaaatttttcctcaattatcttccattcgttgtttgataacttcctatggtgcatggggattccaaggtatttaaagggaacgcaaccagttttgcacccaaaaagatttgcatattcatggtcaaattctttagcctcgccatagcaatatagctcgctcttatggaagtttattttaagacccgatagctgctcaaaagtacttaacactagtttaagatttttggccttatcgaggtcatgttccataaataggatagtatcatcagcatattgtagtatagagagtcctccatccactaagtgtggtactattcctactaagtcaacattattctttgctctctcaattaaaatagccaacatgtccgcaacgatattaaagaggatcggagacagaggatcaccttgtctaagtcctttcttcgtttgaaaatagtgtcctatctcgtcattgactttgataccgacactacctcccttgacaatttggttgatccaattgcaccactggggggaaaagcctttcatgcgcaaagcttgttggagaaaggaccaattgaccttgtcgtaggccttctcaaagtcgagttttaggacgacgccatcaagcttcttcctgtgtaactcgtggatcgtctcgtgtaaaataacgactccctccataatgtttcttcctgacatgaaagcggtttgagaaggcttaatgactttctgtgctactagagccacacggttcgtcattaccttggtgaaaatcttaaagctcacattaagcaggcatataggtctaaattgttgaatttgtttggcctctttttgcttggggagtaaagtaattataccaaagttgagacagtacaggggcagatttctcttatggaactcaagaaagaggcatagtaaatcgtctttgattacctcccagaagacttgataaaattcagctgggaaaccatcaggtcctggtgccttattatgttccattttgaagattgccttcttgacttcatccatcataaatggtgaagtaagaatttcattttccaggtccgttacctgtgggatatcgtctctaaccgattcaaccatggaaaatggttgggttctgatgcaccaaagaggtccttgtaatagttagtgataaatcttttaagattttcatcaccctcaatagtgcagttctcttgttctaaccggaatatcctcgtttttttatgtttcccatttgctaccagttggaagtacttagtattacagtcaccctgtaacaacttagttgttttggctctttggtaccatttaatttcttcctctcttagcatatgagctagacactgctttaagtcaagttcttgagcagtaagcatctgtgtttcggcctttttgtctaaatcatcagccttcttaataatttgctctttctcttttttatatgcaccactggtatttttcgcccaaccccttaggaattggagtagtctttgaattttgaactgccatttttgtagtggggtccagcctctattctcatttttccaaacctgtgtcaccatatccgagaaaccttctctcggaaaccagccgagctcaaatttaaaaggaggctgattgtttgagtgggttccacttcccgtgttcatgagcagtggagtgtggtcagaaatttctctcgtcaaagcttgaaccgttgtcaaaggatactttgactcccactcggtagtaaccaagatacggtcaagagtctcaaaggtgggtacgcttctagagttagcccaagtgaattttcgatttgacaatcccaattcccggagatccaagctatcaatgactgcattaaaaaggaaaggccatctatcattgtagttgtcattatttttttcatgttggtttctaatgatattaaaatcaccaccaacaaaaagaggtaggttttctttggcacaagtttgcaccagttcagccagaaaagattccttgaattcatcttgtgcagccccgtagaccgccaccagaacccaactaaagccatcatccttgtttcatagatggaacttcacatagaagtcaccctcatcaatactactgatgtcaaaaacttccagattaacacctagtaggatgcctccggacctaccgtgaggtttcgaccagtgccataagaagtcccgaccagcacaaatattattcaatgtactttgtgtgaaatcgtttttcctgtttcgagtaacgcaatgaagtctagcttctcttctttactagtatcggaaaggaacctaaatttagccaagtcaccaagacctctgctattccaaaaaaatcctttcattttgtacaccttttatgtttcttaacaaactttatttttgtactacctttgcttcttgaggagccttttgatttatttttcttaaaggcagtgtggaaatcacaacttaggtgatcattgtcctcatccataacctcctccagaaagtcaccacctaagtgtccaagagcgagattttcagattcatacttgtccacctcgtcattatcaaaatgttcaaactctgaaccagaaaaaaacgtgctactatctaattggggttcagaaatgtggagctcaagtctatttaaaagagaaactgaatttgagacttgtttgtgattagagcctagagatacccctagattgctaaccttagtagagataacatcattaggaaaagagaaagggcaagaggatatggagttacctggaccgtcaagattcctccatgcagccctcaacttggccttctccaaaatgtggtgatcagccccgcccgcaagccttgggcttgaacgtttgggctgcgacgccacctccttgatccccgcagcggccaccagcatatctgatgagagggcaccaagtccaggctactgcagccccctcctagaacaaggcggcgcagagacagccccacggcgcgcataaaacgcaaggcattcccgcagacgaccaggacacgattcctgcaccagatcagcagccaccattgtggcttctgcatcagccatcaacatggcctcagaaggagatccaccaccgcacacaccatcatcagatacccctccaaccacagaaaacgcagcaggcaatttgtccaccagcacaccatctagtgagccaccattcacaaccttcatgggacaatcagtaggagattcaaccaccatgtcaatagaaatgccatcagctgctccttccaagtgttcaccatcttcctccgcgataactttatcaacacaaaagtcaagcgtcatatccacgaccatatccataatttcatttgccattttcctgattttttcctccgtatttactccatgctcaagtgccaaaacaggggctgtagaggtgccaccaggggcagccccacccattcccatagaagtgtcactttcattttggcagccagagaggtccttcttagagcgcttaccctctctgtccaagctactgctatcattgggattgtcttcctccatgtcctcattgtctccatcatttccatccccaaagttctggtttacttcatcaccgttttcatcaaaacccaccgattcgacctcgaatcttaattcaaagtagtggtcgccgataacagcatccaactttgtcggcaacaacttgggatccaacacagcaaccaacacccgaccaaaattgttcttgcgagtagtttccatatcaaccgtttgtgtagacccaagcatagacctaatggcccagagattcaaaaattctctcaatttcttcctgattccagtgacccgaatccaaaccttaggtaacagaaaaccttcctcctcctcatgccattcctcaaattgcatccttgtccccatgggcacatttttatcacgggcatccgcacccccaaaggcaatggtcctctgtagctcattcttagatggaaacgtgacaatgaaagagttctgctcatgaacaacaggttcccaattccacttacttgaaacaacacgttgcaattgcgccaccaactgatcacccgaaagagtactaccaacaaccgtaacaagtgctgttttggaatcctttttcctggagagtggcgaatgaggtatatggtataaacccaagccagacaccgcatatccaacaacatgtgccacgggtcgaggttgcttgagcaaatggcaacggtggttgacatgatcatggccatcacatatgacacaatacaacttggtagagcacttagcaaccaagtgccccttcaaaccgcagcggctacagttcttctcctttttccctgtcctgtgcacctccctatctcccgccactaactcctggttccaagcacttgcagcagcatcagagccgacaacgaaagccagctcggtgacagcagcagctgctgcagcatcatccatccctggcacaggagcaggcgggggcctaacagccgcctggacagtctgaacaggacggtagcccctgcccgccgttgccgggtccctggacagatgaccatggtggccagcccgagcgtcgtgccatcgccggccagcgaaacccccgcgacgaggagctaagccacgggagccacgcggtcggaaaccaccccgctgccagccacggtcacgatcatcacctccgtaccctggatcgaatccaagattgcttccttgaaactcgccgccgccaccgccatggagcagaccaggatccacgccgtgacccccgccacgaccctgaccggcaacgtcgcggtctgagcaacgaccatggcctccagcaccgcggcgatccatggcaacaacggccttcgtcttcgcctcgaacaccgcctgtacgacaaccggctccagtgtcgaggatgccgcgacttgaatggccgaggcaagtgaatggacaccgcccggcggcgcgcgtgcaggagatgacaaacacctcggacgccccgcgttcgcaaacaagccgcaaagaccgtccatgaaggtgaaatgggcttttcttccctcaacgcatagtagaatgactcggcccggcccaacagcctgacagacagaccggtctccgagatcccgtgtgcctggccgcgacgcgaggaacgacgagtccgaccgtctcccagcagaaacgcctgacggcgccggagagaaagccgaggcgtgtgccgacaagacaccaggggcatggccacgaccaccatgaccatggaaagtccgcgccctggccagaacgtccgccaaagtgaggtgtggggacaccctagccggcggaagcggccctcgccatggccgccgcgccgccatcttccggacaccagtccccatccacgccgccgacgaacctgtagaaagagggctcaagcgaacgttaggcattgaatctgccactgagggcagcacaaccgaggcctcgttcgttctatagttgagcgcggtcctagtccgatccaactcagaaacgcccaagaggtgctcaccgtcaccatccccccatctttatcctcttcgtcagagcttaactcatctgctaatgcccagaatttcaaaccataggttcgagaggccagctaacggatgagcacaagctctacacgaaccaaccgaagtcccaaagccgaaatcgactccgggaacatcatgcccagccggagctggagccagcgtaagccggcggcccaccccacggcggcgcggcttgccaatgctcaggcgtaccttcgcgtccagacctccgtcggagtaggccacatcgcccgccggagcggcctgcgcgacgacggggctgccgccgccgcggggcgcccgcaccacgctagacatcttgtttatctcgttgcagatctctgatagccgccatataggtcaatcttttagactactaaaacaaacggcttaacgggagccgcataaatgtttacgaacactgttatcataattttttatgctcttatttttttgaccgtcactacagttctgcaagagtcatattatcagtacactaaaagaacatacttatatttatggtcacaaacgaattttgataacgcacgcatgcagggcacgtacgcggcatttactaattatcaagtatttttacgctcatatgatgtatatgaataaaaaaaagactacactattattcccatttttaagaaccacgaaattctctatttataaaccagcaggaaaggagctatactagcaataaaaaatgagatgatgaagttgctaacctttataaccctagaatgaatggtgaaataaactcttaacaaaaaaagtccaggcaagaatggacatgaactctttcaccccgagtgtaataaacaaagggcttcaaatgactggatggcttttttttagtgtccaaccgaaactcgtatgtgtccgtctgcggtctgccgcactagccgttggaatgcaagacttaataatgcttatatattattctcgtcaatgcttatatatatgcgagctttattggtgttcaagtagcatttcctttgtgtgtagacggacgacgaattcgagaggctactgcagcctgcaggcggccatcaaaggcagagcccaagaaaacgttcaagggcgacaggaggaaaagaatagattagtgactttttgtgtaatatttgttttaatcgatttagtatatggtatgttcgttttgatattaaatttttttgttatgatgtttttttgtgggaatgatttatttgttatgatataagaacgtcaccccataccaactaataccatcaaacatgaatgtatacatgtggcaactataaaaaagatcctctctgcatccgtctgcggcactagccgttggacccaagtcaaatgcttacattagtctaacaagtttttttaaaaaatataaatatattaaaagtttatttatatttaaaaaaatattggttaaaattatattttcaagaccgtgtcgctgttttaaacaaaaactcaaagagagtaataatcattactaaaaccaaaagctcactagcgaaacctcataagcttgtgtattttttaatgcgcacaaggggaacggttggggtggttttgaaactctctccccagagttgctgcttccaggagaaacatccatctttcagttgggtcaccagattcaccattgcaatcagcagtgtccagtttaattttccttcatagtatatttgaataagtgagtgtctaggtttcatttgatcatttctctagtctctctgtggcagtgttagctagatggatgaattcgagatgctactgcaggcggccatcaaaggcagagcccaagaactggagcagctggtgcaagacaagccggaggtgctataccaaacaactgaagcagggaacacctgcctccacatcgccgctctctgcggccacggggatttctgcagcaaggtcctcgccctccgcctgacgcaggagccgagtctcccgtcgtctctgctctccaccgccaacgtcgacggggagacgccgctgctcgtcgccgtgaagagcggccgcgtctccctggctcttgacctgctcgagcagcactcgaggcacgagctgctggacgagcaccttctgaagcgagacaggcacggatgcaacgtcctgcaccacgccatccgcaacggctacgagggcctcgcgctgcgactgatcggccggcagcctgcgctctcggagtcccgcaacgggcgcggcgagtcgcccatgttcatcgcggttctcaaaggtttcaggagcgtctacatggcgctgctgagcaacgagaggtcgcaatacagcggggccaatggctccaacgccttgcacgctgctgtcaagtacggagaccaaggtacctgctgcagatgcttgctcttcatgcatttttcccccctcttcgtctcttgcttaaaagccaaaaccgcgaaactaacttgttttttcagatttcgtagaacaacttgtggacaagcatcccgagaaggccaaagtgctggcgagacaagcggacagtaaaagggacactccaatgcatctcactgcgcatttcaacagggataggattctaacgctgatgctgagatgtgatcggtccttggggtacgagctgcacgaggaacactccacgcctcttctttccgtcgccgcagaccgaggccacgtagcttttgctcgagcgcttctggagcactgtccagatgcgccctaccacgacgagcagggcaggacatgtctccacgaagctgtagacaaggaccgggcggagtttgttgagttcatccttgacgacaactccaagctccggaaacttgtcaacatgctagatagcgttgatgacagtgctctgcatctcgcggttcagaagaacaacccgaggatggtccgtgctttgctggatcaccctgacatcgacatcaccgttgtcaaccagcgtaattgcacagcgatctggaatctgtaccatgatggggactacgtcaagactataaactgggtatgtatttctgtatgtaatgtatgagattgcttcattaattcagatggtgcctaactttttttgattgaatccatgcatatatgcagaacaaaatctgctgcctcatactgaatgcagatcgtagagctgaaactgacatctacaatttccaagaggagatcaggaacaaagtaatcgatacaacaaggaaagatgccaagtctctgatccaaacatacacaagcaacacgtccttagtggctatcctcatagcgacgattaccttcgctgcggctttcacattgccaggagggtacagcagtgatgctggaagcgaggggctcccaatcatggctaggaaggtcgcgttccaggcgttcttgatcttcgacacctcggcgatgtgcgcctccctcgtcgttgccttcatatgcgtcatagcaaggtggatggactttgagttcttgctgcactacaggtccgtcacgacgaagctcatgtggttcgcgtacatggcaaccacccttgcatttgcgactggtctgtacacggttctggaagatcgccttccttggctggccattgcgatctgcgttctgtccgtgctgctgcccgttcttacgatgctggtcggcaaatggcccatattgaagctcagaattcgatacggcaggtctgatttccttgacatggtctagacttcacggacatttcaccaaattaatccgctcattgaattgctttacaccctatcatgtgacagaaatgcattaacagattctatatgtgttacccttgacatttcaccatagccgttcatccttattcgagatattgttttgtcctttaacgtaacaaaaatgcattgacagattctacgttacccttaacatttccctatagccgctcatccttatttgagatattgtttccctctctcatgtaacaaaaattcattgacagattctaaagtttgcaatggtctaagagcatctccaagtaatgactcaaaagctccccaaaaccttgtttaaaggtgaaactcagtttttattactccaacagaactccaataactgtccacaatttttcgcgtcccagaaacgaagctaagtatcccgcaaatatgcgtgagtagatttctcccccaatcctgtgcagcggcagagtctgtgcaacatgcaacacaaataaaagtaccagggacatgcatgaaatgaaacggaccaacaatttaggcaaaatggccctacaatttttaaaatttggcctagtttcgtttttagttttttattttgagggaattgttggaggatcaccttgtttcgcacctgtaaatgtttgcgtatgtccctcataatcagtttttagggatttttttttccattttcttttggagttgctctaagaagtgatcctcaccccaaggcatctccaacacaaaccgcaactcaagaaatcgatggatcttcaaaaaaatctaagagagaagagagggatcgagagtgaaaacaaaatcgaataaaaaattgcagcacacacaaactgagcacattgatttgacaatttttttttagaaaagggaatattattaatattccagcttctgtatcggttgatacattcggctgtcaaactcacaaacatggggttccacattggaacgaaatctaacattctacaaaggtttcataaatttaagctctcaaactatgctgtcaatctatgaaaaaaagaccatccattatttgaaaagatctccatcattgttgttttaagcacacgacaaccccattttacttgaggtctgtcctcctccttctgcaacagtgtctagaaccttgtccaatgtgttcctctgaaagtgacctgcaagggagtggaaacttgtgcattatcaaaaaccacatcattacgacttaaccatatagcccaacagagggcacatgctccaacccaaatcaggctcttaagtctagaatttaaa

SEQ ID NO: 632 - protein, 731 aa, Zea mays
MSSLLLRVLLIQLAAVECLSAAIPGCLTQCGGVEIPYPFGVGTNCSRKGFRIKCINGSAGEEIPVLLPTTRYQNIRVLNLSVSPLPEARVLLPVAWQCFNATGGVTGIYSGDVDFNPEGVYRISNTQNELFVLGCDTYAFTKGVRVHNVNARFPYRYFTGCITVSVDDKDPRDGACAGLGCCRVDIPPGITDTSMTFSSTWTRANQTFCPCDYAFIVEKGNYTFKASDLVSHTPDNRLPLDWWTMPLRLDWAIRDNNGDSMTSISCAQAPNEPDYGCRSKHSECTNSTNGPGYFCKCAHGYDGNPYVQSDGECTNINECQDPKSHNCSSGSKCIDTDGGYYCQCNFFRRGQQCDPLIPMAAVALLTTFAAVVLGCVAIVLLQTLNNRKRFNRNGGKLLNAQGITTYTKRELKKITNGYSKRLGGGHFGNVYEGTIVDGRKVAVKCPLRTRVSSHRCHWKNLIRPRRVPLPQQRVEEDGSFMNEIRFQFEVSRHKNLVQLLGCCLETDIPILVFEFVANGSLEDILHSAKKPCTLSLPERLDIAIGSAEAIAYMHSLDNQKRVHGDIKPSNILLDDDLNPKVSDFGSSKLLAIHSYYVRAVAADIGYMDPLYMKTEHFTLECDVYSFGVVLLELITRRRASWYEQDHQGNKILPIEFVKCFKDHGSGCAMYDSRLDFSAGEDAQSRCNKRCLDMIGMLAVRCLKEDKRERPTMAEVVEELKRVKVLLLGTHI

SEQ ID NO: 633 - DNA, 3876 bp, Zea mays
ttcggatgctgaatctgtacaccatgccctgaaaaccgcacttgtgtagtttgtgtgactggtacagtagaagatagaaggggcgccggggacccatttaccatactctgatgactgcaagtacgttcatttagagtgaagtaagctacacagctcaccagttggtccagacgtccagtgagcgtacatgttttgaatgaggggcatgtggagagcacatagacagttgagtccggcactctcctggatcggaattgaattttatttgcagcataatcatgtgtggttctccaactgaaccatagcctcgttcttctcacccccttcaaaaaaaacgaggggctggctggctggctggtagtagtagtaacctgcttgttagctggactggtgatttcaaaccgtgatgggtgggtgcacatgtcctgatgtcactcgaatcgggttctgttttgccgcgtcgcctttgcacgccgccgtgatgtgccgctgccaaccttggggggatttcgaacggggacgacgaaccagatccaccgcgcagcgtcacccagctagcctgctgcctgctggactggaaccgggggaagcctccaaggcgaaggcagcagcaggaacagtagaagcttggggatgtggattactagactattattatttattagactagactagagtagtcatggggatcaacgacaccccttgagatctcccacatgcaaacgcgctcgattaacctttttttactactttcccaaacaaaagtcgccctcccgaccaactatatcaaaatcaaatcaaatgctttcaaaccaatcgaatcaccaccgggcggtccttgcagcgcattcatttcaaatcgctttccccaaactacccctgccttccctcaatgatctagtctacaggtgtgggtttcccgtcatttcgccgctaaatcccagtcacctaaaccccacgcccctatcgctcccctccttccccttctccgcagctcatcctccccttgtctgcgacccagggaatggcagcactgtcattctagtcactcaacaaccaccaccacctgcacccccgctcgctccgggcaatggcggcggttctggcggtcctggtgtcggcggtggccgccacgtccatcacggccgcggcgctcaacacggacggtctcgcgctgctggcgctcaagttcgccgtctcagacgacccgggcggcgcgctgtccacgtggcgggacgcggacgccgacccctgcgcctggttcggcgtcacatgctccaccgccgccggccgcgtctccgccgtcgagctcgccaacgcctcgctggccgggtacctcccgtcggagctctcgctgctgtcggagctgcaggcgctgtcgctgccctacaaccggctctcggggcagatcccggcggccgtggccgcgctgcagcggctggccacgctcgacctcgcgcacaacctgctgtcgggcccggtcccgcccggggtggcgcgcctcgtctcgctgcagcgcctcgacctctcctccaaccagctcaacggcacgatccccgccgcgctggccgcgctcccgcgcctggccggcgtgctcaacctcagctacaaccacttcacgggcgccgtcccgcccgagctcggcgccatccccgtcgccgtcagcctcgacctccgcgggaacgacctggagggggagatcccgcaggtcggctcgctcgtcaaccagggccccaccgcgttcgacggcaacccgcgcctgtgcggcttcccgctcaaggtccagtgcgcgggggccgccggggcggacgacgacccgaggatcccgaactccaacggccccaccgaccctggcgctgcggcggaggtcgggaggaggggaggcccgaggcagccgcggcggcggcgctcgtcgccggcggtcccggtcctcgcggccgtcatcgtcgtcgccctcgtcgccggcgtggttctgcagtggcagtgccggcggcggtgcgccgccgcggccggggacgaggggaaggagtccggcaaggagaagggcggcggcgcggtgacgctcgccggcagcgaggaccgccgcagcggcggggaggaaggggaggtgttcgtggccgtcgacgacggcttcgggatggagctggaggagctgctccgggcctccgcctacgtcgtcggcaagagccgcggcggcatcgtgtaccgggtcgtccccggccgcggccccgccgtcgccgtccgccgcctcagcgagcccgacgacggcgacagcgatggctccggttctggctccggctggcgccgccgccgcgcgttcgaggccgaggctgccgccatcggccgcgcgcgccaccctaacgtcgcccgcctccgcgcctactactacgcccccgacgagaagctgctcatctacgactacctccccagcggctccctccactccgctctccacggtaacagatctgtgttccgctagcgatagcaatgagcaaggataatacatagattaacaccggcaagagccgttccgttggttatctgtcccaggtggcccgacggcgtcgccgacgccattgccgtggtccgtgcgtctgtccatcgtgcagggcgcggcgcgcgggctggcgtatctgcacgagtgcagcccgcggcggtacgtgcacggctgcatcaagtcgtccaagatcctgctggacgacgagctccgcgcgcacgtgtccgggttcgggctcgcccgcctggtcgccggcgcgcacaaggccgccggcggcgggcactccaagaagctcggcagcgcggcatgcgcgctccgaggcggtggcgcggcgtcgtacgtggccccggagctgcgcgcgcccggcggcgcccccgccgcggccgccacgcagaagggggacgtgttcgcgttcggcgtcgtgctgctggaggccgtgaccgggcgcgagcccacggagggggagggcggcgtggacctggaggcctgggtgcgccgcgcgttcaaggaggagcggccgctgtcggaggtggtcgaccccacgctgctcggcgaggtgcacgccaagaagcaggtcctggccgtcttccacgtcgcgctcgggtgcacggagcccgaccccgagatgcgcccgcgcatgcgcgccgtcgccgagagcctcgaccggatcggctgacttccagcgcgacggcgtccggccggccgccggttactgatcatcaactacgtaggtgcaatccaacgcataaaagagactcgcagtcctgttcatgtagattagcgcagttaagcattgtggatttcagagacggtaaacgcaggtaaaaacaatcatcatccgctccatctgtgaatgacgaaggtgaatcactcgacgtagcaggctataggctagcagccgtgctaatattttgtggcaccccttgatccattccaaagcgaactctgttgggagttttctatcgttttgccactgcctacaactgtgcggcgctttgcccaaaagcttgcgatgcgttccttggggacctgggactctgggaggcagagagagcagacaggcttttggccctaggctgtgcggttcacctttggcttggtcgaattgactctgaaaagatgcgacaatgacacaaggtgtgctgcacccttctggtcagtgcactgtcctcttgcctgtgctgctgtgcagtgcaggagcagcatgcttttgcaagtttgcatgcgtaggagtaagtgacaaacaaccaacaggacgccagcgtcaagaggtgtcgattggtcattggagaagggctgttcggatggagattttgtttgaatttcttgatgcaaaaccattgcctgaaacgtgtagcaatcatgctcatgccgaacgt

SEQ ID NO: 634 - protein, 362 aa, Zea mays
MLHRRRPRLRRRARQRLAGRVPPVGALAAVGAAGAVAALQPALGADPGGRGRAAAAGHARPRAQPAVGPGPARGGAPRLAAAPRPLLQPAQRHDPRRAGRAPAPGRRAQPQLQPLHGRRPARARRHPRRRQPRPPRERPGGGDPAGRLARQPGPHRVRRQPAPVRLPAQGPVRGGRRGGRRPEDPELQRPHRPWRCGGGREEGRPEAAAAAALVAGGPGPRGRHRRRPRRRRGSAVAVPAAVRRRGRGRGEGVRQGEGRRRGDARRQRGPPQRRGGRGGVRGRRRRLRDGAGGAAPGLRLRRRQEPRRHRVPGRPRPRPRRRRPPPQRARRRRQRWLRFWLRLAPPPRVRGRGCRHRPRAPP

SEQ ID NO: 635 - DNA, 6605 bp, Zea mays
ggaggatccgttcgcggaaaagtgtggagggggccggagctgggaacgagcgggagcgtgcgggagcgtgcgagatggacaaagacgggaacgggagcgagcgcacaacggctacggcgagggctaggtcgccggagaagagaatggattgagccgtacgcggggggccaggaaagtggaaaaagcgcagtcgggcgcggggaagtgaaaaggcacaatatcggttccgctgcgtcggttcggatgtgtggatcggttgggtcggaccatgtgcacctgggcgcctgggtgcattctctatattgaatgcacccaggtataatatataataacagtatatatatatagggcaagaggagaaacaaaaatggatgcaacaattgacagtacctcaatgcaattctattcggtgaggacatttcttctaccgataatgaactcataaaaaaacggacagctatttttttcttctacttaaaaaagaaatcaggaggtcgcactaagcctcttttttttcaaaaaaaaagaacattacttaggtagtaatccagaaacagtaaataacgacccaaacccaaatgctaaaagctctccggcggcggctgctttctggaggaggggaagagacggtttgggcttcggccctttttattttttttggcgcttagagcaactccaagagattagctaaaaagactagccaaatttactgatttagctaatctctaaaatagattttagagaaaaagtgtaggctaatccaacagactcggtaaacctacggactgaatagagagtgaagcaggctatccaaaattggagagcgaagatggagaaatagagagccactaaatttgaagagtcatttacagagtctattggatacaattttcttttaatattagctaaatttacctttacaaaaccatatatctagtctcttggagttgctctaactttttaggcctgcagactgaccaccaacgcagtgaccagtggcggccactctaccaccaacggtttggtcttcgtctgtacacccgaacctggcatattcatacggtgactgcaaggtgagccacaactcagaggcaagcagagtcagcaaagatatatgaaagggaggagaggggttgaacagattattactctcagaaaccagccccttctaccctaccgttcttcctcctatacaatacaacaactactctcttgcgttgtactcggagccaggatcagatggatgcccttgctttgctgcctatcctgatctcttctcctctcaggatgtaggcagatcgagtaatcagtggctcacattttgacaagacactcaaggttcgtctcgatctccaccctgcttccatccccctttgtttctgtatcagagagaaataatggcttcctagttgctgctacccatctatgcggtagccggtaggcaaacatgcgaatacttcctcagcaaatcctatccagccactccaaaaagtatccacagattccaaagacttttagcaaatccttaaggtatagtagcagatctgacccagcgttgactttctcagcaagcctcaaataagaactagctgatcagactttcaattagctttttttttgttggcagatcatcagacttcaaaagaactagctgtcccttttgcattacatcttatagaccagttacagtttgctgctcggtaacagatttcttctattcatgtagggagcggcactgatgctataaggtgagccttgaccttattccaagtctgatcgaataagaagggatggcagagattgctgttcttctcgtcctgaagaagattgccatagctctggcaggagagaccctaagttttgctaaaccattgcttgcaaagaagtctgagtcggtggcagcactcccagatgacatgaaactgattagtaatgagctcgagcttatccgggcgtttctcaaggaaatcggcaggaaaggctggaaaagcgaagtgatagaaacatggatagggcaggtccgaagactggcttatgatatggaagacactgtagaccattttatttacgttgttggtacacacgatcagatgggatcatgctgggattacatgaagaagatagccaagaagcctcggcgtctggtttcactagatgaaattgctagtgagattaagaagataaagcaagagcttaaacaactctcggaaagtagagaccgctggactaaacccttggatggcgggagtggtatacctgcaggaagctatgaaactgaaaaggaaatgtatcttcctggacatgattacacaatcagcgacgaggagcttgcaggaattgatgaaaataagcaaaccttgattagttcattaaaatttgaagatccatcacttcggatcattgctgtctggggtatgggtggcgttggaaaaagcactcttgtaaataatgtgtacaaaaatgaaggatccaactttgactgccgtgcatgggtttctatctctcagtcatatagactagaagatatatggaagaaaatgctgacagatctcatcgggaaagataagatagaatttgatcttggaacaatggatagtgcagaactaagagagcaattgacaaaaactctagacaaaaggcagtacctgatcatactggatgatgtctggatggctaatgttttttttaaaattaaagaagttcttgtagataatggccttggaagcagagtaataatcacaacaagaattgaggaggtagcttcactagctaagggtagttgtaagatcaaagtagaacctctgggtgtcgatgattcctggcatgtattttgtaggaaggcatttctgaaagatgaaaaccatatctgccctccagagttgcgtcagtgtggtataaacattgtggagaaatgtgatggtttgccattagcccttgtggcaataggaagcatattgtcgctgagaccgaagaatgttgacgagtggaagctattttatgaccagcttatctgggagctacacaacaatgagaaccttaatcgcgtggagaaaattatgaatctaagttataaatacttaccagactatttgaagaactgcttcctgtattgtgctatgtttccagaagactatctaatacacagaaagagattgattagattgtggatagctgaaggatttattgaacaaaaaggggcatgcagcttagaagacactgctgaaagttatcttaaagaacttatacgacggagcatgcttcacgttgcagagaggaactgctttggtaggattaaatgtattcgaatgcatgatcttgtgcgtgaacttgccattttccaatctaaaagagagggtttcagtacaacttatggtggaaataatgaagcagtgctagtgggatcatattctcgacgagtggctgtgctccaatgcagcaagggcattccatcaaccattgatccatccaggcttcgcaccttaattacattcgacaccagcagagcattatctgtgtggtattcttctatttcctccaaaccaaagtaccttgcagtattagacttatcaagcttgcctattgagactattccaaattcaattggagagcttttcaaccttaggcttttatgcctcaataaaaccaaagtgaaagagctccctaaatctattacaaaacttcaaaacctacagacaatgagtcttgagaatggggagttagtgaagttcccacaagggttttcaaaactgaagaaattgcgacatcttatggtttcacggttgcaagatgtaactttcagcggtttcaaaagttgggaagctgtggagccatttaagggcttgtggactttgattgaactgcaaactctgtatgccattacagcaagtgaagtattagttgcaaaacttggaaatttatcccagctgaggcggcttataatttgtgatgtaaggagtaacttatgtgcacagttgtgtggctctttgtcaaagttgtgccagctgtcacgattaacgataagagcatgcaatgaagatgaagtgctacagctggatcatttgacatttccaaatcctcttcaaacccttagtttagatggacgactgtcagaaggaactttcaaatctccctttttcttaaatcatggaaatgggcttcttaggctaatgttgttttacagtcagctttcagaaaatccagtaccacacctctctgaattgtcaaacttgactaggttatcccttataaaggcatacaccggccaagaattatacttccaagcaggttggttcctgaatttaaaagaactttacttgaagaatttgtcccggctcaatcaaatagacatacaggagggagctttggccagccttgaacgtataacaatgaaacacctcccggagctacgggaggttccagtcggtttcagatttctcaagtccctaaaaacaatatttttttccgatatgcatcctgagtttgaaagcagctttcaaaaggaaatgtagatcatatcccgtacatatgcaggacaacaacataaggcaagtgaaagcttctcaacctacagcttaaactcttttcatgtctttactaaagcttttaagctttatttgtcgtcaaatgactttaggtaccacttaactattttcaaatctagatgttttcttgtgtagggctacaagtgtaaagtcctgttgcaataatgaagattcccctgaataactactccctacagtcacaaaagtatgtttagataagatttggtcaaacattaaaaactacaaacatcaatacctttgaagtctttttgtttggtgacatatatgataacttttttagatagcaaaacatggatgaaatatgtgcagatttgtgactaatggtttatgcaactgtggtaactaaaatgtggctctgttagcaacttagatcctagggggctgagcatctaggtctttgtcagagatgcttatgactgcttgccgtaatgtaatgactggttctggagtggccacttaggatatactgtgcaacaacaagactatggatctggtcttaactaattactttgagcttgtctcgtctgttagcagcttgcaagacgctaagcaaattggtcactaatcactatgcaaaaaatcacaactcagcaccatatcaaagcattgacaattggtatcacctttttgcagtatggtttgtttgtatgtctacgtgtaccttctgtcctctcccaaaaatagggcgggttgcattggcgaaaagttcatgatgggtgttttgagcttgggcaattactgtggagaggaaatgcagcactaggatccaagctttcgagcagaaagcagcgctgaagctgaagggcatgtcatgtcattcaggtacctagtaggatccaaaccttcgagcagaaagcagcacaggcactggcaccaaagaggaaccatagccgccaggcaacatcagtcatcaggaccggttaataatgtttatgtgtgataatgttgtttcaataattatttggaaccatttcgaactccgaatacttgagagtctgtacgaagcatttggcaataaatactatttcagagtaattataggatactataatttatcattccaactgcagccaagctgctgcagctgcaatacacaaaaataaaatatcttagaagctacagtcgtaaccgaactaaagccacaggctgcagctgcaatacacaaagataaaatatcttagaagccacagtcgtaaccgaactaaagccacaacgaacatgctgacgccctcccgttaccaagttaaatgcaattagcactttgcttgtttgctctcactctgagttgatctttaatgccatctatattgtctgagattagtcttcttgttatcgttatctcccttgtgcttgttattattgcagttcttttgtctggcctaatagatagattgatcaagtgaaagttatagatctatggctattaatttgtctggttatggatctccaatggcatctgtattatttgggactagtcttcattatctcttctatttctagtatcattatgattttttcccctggccaaggaattagattggtagactgaaagttatatacctgaggctgattaatttcgttccatttctttctgaaaatattcggtgtttcttttttaagttttcaagctttctttttatattgtagtatgtatattcttgtcatctctgtattttattacgcgtaatgtttgacagtttgaacgagctccctatgtttaagtacaggtcctgcccctgtgcacctatattgtacctctaagtgcagattacatatactaagaaaccaacaagatgagaaacacgcacaccaatttcggaggcaattacagagacagatttaatactgacatggtactcagcttgctacttaatattttaattggctagtgaaagccccaaacagttccgacctctctgcaacagccagggaaagaagatgtaatacccactttgtaaaagaaaatttaagagtagaaattatattgctttgcatatatgagtgtcatccctatttatcatttcatgtggacacctcatttac

SEQ ID NO: 636 - protein, 905 aa, Zea mays
MAEIAVLLVLKKIAIALAGETLSFAKPLLAKKSESVAALPDDMKLISNELELIRAFLKEIGRKGWKSEVIETWIGQVRRLAYDMEDTVDHFIYVVGTHDQMGSCWDYMKKIAKKPRRLVSLDEIASEIKKIKQELKQLSESRDRWTKPLDGGSGIPAGSYETEKEMYLPGHDYTISDEELAGIDENKQTLISSLKFEDPSLRIIAVWGMGGVGKSTLVNNVYKNEGSNFDCRAWVSISQSYRLEDIWKKMLTDLIGKDKIEFDLGTMDSAELREQLTKTLDKRQYLIILDDVWMANVFFKIKEVLVDNGLGSRVIITTRIEEVASLAKGSCKIKVEPLGVDDSWHVFCRKAFLKDENHICPPELRQCGINIVEKCDGLPLALVAIGSILSLRPKNVDEWKLFYDQLIWELHNNENLNRVEKIMNLSYKYLPDYLKNCFLYCAMFPEDYLIHRKRLIRLWIAEGFIEQKGACSLEDTAESYLKELIRRSMLHVAERNCFGRIKCIRMHDLVRELAIFQSKREGFSTTYGGNNEAVLVGSYSRRVAVLQCSKGIPSTIDPSRLRTLITFDTSRALSVWYSSISSKPKYLAVLDLSSLPIETIPNSIGELFNLRLLCLNKTKVKELPKSITKLQNLQTMSLENGELVKFPQGFSKLKKLRHLMVSRLQDVTFSGFKSWEAVEPFKGLWTLIELQTLYAITASEVLVAKLGNLSQLRRLIICDVRSNLCAQLCGSLSKLCQLSRLTIRACNEDEVLQLDHLTFPNPLQTLSLDGRLSEGTFKSPFFLNHGNGLLRLMLFYSQLSENPVPHLSELSNLTRLSLIKAYTGQELYFQAGWFLNLKELYLKNLSRLNQIDIQEGALASLERITMKHLPELREVPVGFRFLKSLKTIFFSDMHPEFESSFQKEM

SEQ ID NO: 637 - DNA, 10652 bp, Zea mays
accctccggctacaacatcacattcctctacaattgcaagaagaacattagagcatctccagcaggtcgtgtaaatagtcgtgcaaaatacgattttgtactatagattacactgtttgcagtgtaaagatagagagttggataaggagtctactggacatattaccctgtcctctaccgtggaactgagtgggtacccacagcaacaagaagatagaagtaggtcgtacgtgttgtcgggtggtgggatcatgtgtgctgaggcgtatgtatacatgtccaaataggcaggtcgggccgactcggcctgagcccgactaggctcgacacggattaggatcatgctggcttgacccagattagcaagcaggtcatgtcgtgcctgcccacgggtctcgagcgaggcccagacacgacacactaaggtattaaccgtgccgaaccgactcacggcccgacaggccaaacatgtctataatagtatatgacgtttaaatgtaaaaaatatgttaaaatatacataacgaaggtttaaaccatatttattagctctaaacacctatttacacccacgtaaccaacaaaaaaaatatgtttactgtattttatactatatatattcaagtataatgtatgtatttgtattaaaaataggaacacaattaaaaatgggtcgtggcgtgtttagcctctcgtgccgcgcgtagactcagacacaacctagtcaccgggccgggccatccagtgcctgagtttcggaccgcccgacccggtacaagcacgggtgcgagggcgtggtggtggcgccgccggtgctggagagttatttatgattatgatcatctcgtcgcgcggcttcgccactttggtatcccgcagctcgtcatcgccagattggtattgtcgtcatgcaccactcgtcagattgggttcgttttcatctaataggcttctaacagcgcgcatagcttcatacgactgactaatttacccttctcttttcccagtccggggaaataaactgatgagcaatatgtacaagagaaaagaggatcctaattatcattaacttcatccccaacccacgttagcacgccgcccagccgccctccttgagcagcccgcgcacggtgctggctagcgtgggctgcgtcgccgcgtcggcctccatcacctgcagccgtgtcttcacggtgtccagcggcatggtcaccagtgccgcggtgcccccggccagggccgtgctcgcgccctgcacggccatcaggcaggcgcagctctcggagcgctcggtccccacggggccggccgccgccggatctcctccaccgctgcggccgccgccgcagcgccgctctcctcctccatgtctacggcaccgaagctagaatgaaagggcagcaatgtcttttaccgttttacattcgttgtttatctggcttcatcggtaacgaatccaatctggcgagttatgcacgacggcaataccaatctaacgatgacgagccgcaggatacaaaagaggcaaagcctcgcgacgagatgatcataatcataaataactcggtgctggatgtacacaagaagggggaagagaagcccgggcaccaccggcggtccgcctccggaacggatcgctctgtcggttgctgcagggcgggttcgagctgaactacgacactcactccgagcagtgcgtccgatgctagggctccggcggatggtgtggctacaagcgcgaggagaggcccgccggcgggatgacattcgcctgtttctgcgacggcggccagaccacgggccgatgcggtgccggtatgtctctgttttttttcttcgaacaaggtttggcatgtgttctaccgtttcaactagtaaatgattacattgagctaggcagctagccacacattttcttgaatgattttcttcgatgaacctgctgttttcttttatgacgtgaacaaccgggcctgcaagctgccacatacctaggggctagggagactagttcgtgaccttctttacacgtcttctctactttgtgacgttcaaccagagtccagagatgtaattctctgcgaaattgcgaaaacaggactagttggaggcttggagctaacaacgcggcttgatgagggtgaacccagccccacctcgtctaccacgtcttctcctcggcatggctgctcacctaccacgtctccccgtcctcctcctcgtcctcctcgctgcccatgtcgtctccacctccacccgtgccgagcctcctcttccgagcacttacaacgtctccatgttctcggaatcgttctggtgcggcggaatcgagttggaatggaatcggacatgggaggatcagtgtggccagtgcgagggattgggctccggcggacggtgcgcctacagccagaagagagaattcctgggctgcttgtgcagcggagggaaggtgggcaacccgttctgcaaaccatcgacatcgagtaagtcctgaaccgagcctcccttgttttgttttttttcattttttgcaatcaccagagcatgcatcggttgcgtcagtatcttgcgactagggccctgtttggtacagctgctgcttgttgaaaaagcagcttatctgataagctggtgaaaagcagcttctgcttgttggctgcttttagtgtattctgagaagcagctgaactgataagctgctgcagaagctaactgtttggcagaccttctgcttaaatttatgaagaagctgaaaataagctgtgccaaacagggcctagagatgacaatgggtaaaaacccgctgggtattacttgcccaaacccatacccgcgaagaaaaattacgcccgctaaaaaacccatacccatggcgggtataaaattttgcccaaacccatacccatgcgggtttcgggtacccaacgggtttcccatacccactaacatcaacataaaaaataattcatcatgtaaatgacaatcaatacattaataagctagcataaaaggaacaaatgataactaattttagcctaaaatttgttacatgaagtttatttcaattagaacatatttaattaataatattatgagacatatttataaggaatgttgattttaaggcgggttttaaaaactcatgggtttgcgggtatgagtagtggaagaacaaacccatgcccatgtacccgttgggttttcatttgaacccattaacaaacccatgggtagagaaattgaccaaaacccataccctaatagagcaaaaacccaccgggtttcgggtagcgggtacccattgacatctctacttgcgactctcgttctgcttttgcaccaaatccgtgttttttcatttcgtgatcgagattaatcgggcatagagatgacaatgggtatccaaaactcgaaatccgatgagttttttaccccattaaggtacaagtttaaatcaatttttatattcatgggtttgttaatagtcataaatctatatccaacatatttatggataagggtttgtttctacggtaatcaaaaccgtgaacccatgggttttttaaacccgaccaaacctagtgcatattgtcattttattttataaacgaacaacaaaattgttatatccctatttacttcctattttttatcgattggtgaatgtataagtagttggtgagagtgtttcttgcttgttattatagtttttactagcgttatatatgtggtggatagataatttagtgcaagttcacttgattatacaacttattatttgtattcattctctctactaataatttttatatcaaatcataaacgctgtgtttatcatataaattttggaccatgatctcattaatcatgatgatagttattgattatgagaagaacaagcatattggagataaaacccgtgggtaacccgttaaccgatggatacgggtttgagcaaaatttcaaacccatcatggatacagggttttttaataaatatagatatgttttcacgggtacgaatttgagatgacaaaattcaacgggtttgtatctgttaccatctctatccggcggctcttaccgtcatccacgagaagaggtcttatcgtgcctcttcccgtgtcgcctgcttcgcgttgccgaacggagacgtttggtagcgttggccggctgcccggctctagcagtcgggtctctttttccaatgctgttagatttttgttccgtataagccatgttttagtaatttatttagtccatccgaatccgaagacgtgtttgctgggttggagacttggagttgctagtcatgatatgctttttactcggtttgatttcagcccagctaggttatatttggatactatattatttatcacaatacacatggtttgaaaaagattaggatgtaaattagtttaatttatatctcaatttctctcaatctatttgtattaggatgaatactagagtattaaaaaaccctaattttggatgcatttccctacagttacacatggccactgttgtgtgtgggggtaggccgatcctactcgtcgttcgagagcaagcaaagatactgaacaagattagagggactaaaagttccttactatttaaaattgaataataaaatgatttaatccggttccatatctttactctgaacaaaccctcaatgatcatatatctcggaggatccggccggctgttctttatttatgaagtgatgactgctgaccgcttatagaatatatattttaaagcaaaatttcttctacagcagtaaaaggactagacgaaacaatgatgcatttctctaagaaagaaaaagtagaattatcaagtggagagccaagaccaagagccttgcttctatgggcgtcattgcgtcaacaatgataagtctgtttggtttgtttctctcgtcaacctggctgtgttctggagatgcgaccaatctgctcgtatctggtgagcctggcccagagtgctttaaggatcgtgcgagcctagatccaaatctatatacagccaaccaaacacagagctcgcacgcgcatagcctggctcacagcaaccaaacaacagctacccgcatcctgtgatgcaagcatgcgcagatacaggcaaccaaacagaccgatacgagccgcgagtgaaacatcccccagctggtctgtactgtctgtcaccacccaccgagtaatcataccactggctacgctattaggcttaaggctgcacgaaatactcttcattaacgagccagctcgtgagttaaacgatctatcacataacgaaactatatgtatattatttacataaaaaataataaatatgatatatatatatatatatatggtgtatatgacctatgaattaaactaatgattgataaactgtgtctatatgttaaattgctctatgcaaatataactatgggttaaactggtaaacatgtgtgtgaattgatgagtgaggagttgtgtgtaatttgatgttatattgatgtgatatgtgaaactatgggtataattactattttctataattaaatttatttaaaattaactagaaattgattatatatatatatatatatattatttttctgcgctagctcgtgagctaaacgagcaagctcgagctcgcaaacgagccaaaccgatctggctctgtaactcgttagcttaacgagccgagccaactcgttagcttaatgagacagctcgaactcggacgagccgaactgagctagcacgatatccatccctaattaggttcgtaccagtgtagcatatccctctcgcctttgtcacatccagtgatggcaatgggcctcgatttctcacatggaattcctctattaagggatggggatgtggaagtttctcccacagggaaaaaattctcctccgacgggtaaacggggacgacactttccatccccgttcctcgttggtacctgttaaacttacatatgatgatgttttcatgtaaaagttaatgataaaaataaataattaacttgtcaagagatcgcttttttacaaatatgttcattctgatttatatattttttccttacacctgacaatgtgttgtattaataacaaaagaagtatttgcttataatttaagtggggacggggatccccgacatggatttgtatctatggggaacgaggacggggaagaaatgtccttacaaactttcgtggggatcctcgcaagaatctttttcatcgtggggacgggatgggaagttaaaacccgatggagaattccccgttgccatccctagtcacgtcaactctcgactccactattgtccctgatgcacaatctgtagtagactataacctcagcctatagcacatcagcttttctatttcagaattaagtaattcacgcagttttatttcaacgctcagaaattacacaacataatatttttattgaattaaaaattacaaagttcataataattaaaataaaattatattataattaaaacatacataaatctaatcagagacctcgatctcgtcctcatcttccaccacctttttccattatgctttcggttcctcttcttcgtcatcaacaggaccacatccttctttgaacatgtttatggcttggcatgggttcatctttcagctaggtccatatctctggttgatcggccctttagaatattccattgctttaaaagcttggtcttcactaatccaccccacaagttcttcattttaaattcttcacttgttgaccgttgctcgtggcttccttccctttccccttccccttcgccttcatctttcgcgcagctgcctttgccctatcacgtcccattggtcggggcacttccttctttgtatctttagtgcctccaaaactatattcaccagagactctgagtcgggttatcttattcgtagtcccattttatcttagaaccttgccattgctgcctccatgaccattgcctcgtctgctccactctgacgcaacttttcttcttggaggtattatccaatgaacttggtcacctcccggttgtaggtgtcctaatgagttttaagttgcttggcggtttgaggacgtcgaggttcggaagtggagctatatgttgccgctatttgaccccaaaaacttgatccagacttattgttgatagagatggaatcattagaacgcatattccaagaattaacctacaataaaacctataatataagtaaactacaaatatcaatattaaataaatgagaaatgattcactcaccaactttttctcatcggcaatcatctagtgtagtctttttggacgctttttcttcggcccaggattttcctcaccttggttttcaaatccaacatagacgggacatgtaggtggaattggaggatgtgctccatacagaaggtggagcatatggaggaggggcgtatggaggtactgagaaagattaattagactatatttacaatttctaactagcatctaaacattaaatgttatagggattaaattttagttagtgaccttaggcttttagagttgagttagtcacagcttggtttgttacttgtttgttctctcttgcgttgatttgggacctccctataatgttttatcaccttctaaaatacgcagctgtcttgcgtattgcaggcgtgtgttttcctatatttttgaggctcaattattaaggaaattattctcagcgagcatataaccgttttcgaggtaaaatgaagtaaaagcatatgggcctgcctgttcgcataagtacaccctccgtctaaaaagaataaaaatctcatttcttgatgagtcaaaaagttcaaatttaagaaaatatatgttatgacacgaatatttataatgcgtaataagtactgctaaattaattttaaaataaaattttcataataaacctatttgaagatacaagtattggtactatttctaataaatctaatcaaactggtgttatatcttttgtaacaaatttgtgctttatgtttctggtgacgtgaatcagcttaatcttgctcaaatctaacattgtcttttgttcgttggcatacaggatcaaaaagaaaagaagcagcacctattgttggtaagagcctatagtcaatacacatgttcatttcgtctaaaagagcagaagaaaagcatgtgatgaattattgccatgtcatgtttaaaatacagaattctcaaaaacaaaaaaaaacttggaatccactaaccactgatagcattgtagaaaatttcatcctcccgttgggcagtacactgatgagtttacatgctgactagtggtgcgcatttgttctttgccaattgagtttttagaatgctttgcagctgaattcacatgtgattttttttgtgatgcaggtgctgttgccgttgcattcctgtgtctagtcattctcacatccttcttggcttgtagatatggtttgcttcccttcaaatcgaagaacaaaccagggacaaggattgagtccttcctacagaagaacgagagcatacatccgaaaagatacacctacgcggacgtgaaaagaatgacaaaatccttcgctgtgaagctaggccaaggtgggtttggtgctgtatacaaaggcagcctccacgatggccgacaggtagcagtcaagatgctcaaggacacccaaggtgacggcgaggaattcatgaacgaggtggctagcatcagcaggacttctcatgtcaacgtcgtgacacttctagggttttgcttgcaagggtcgaaaagagcactgatctacgagtacatgcccaatggttcgctcgaaaggtatgccttcaccggtgacatgaacagtgagaatttgctaacctgggaaagactatttgacatagcaattggcacggccagagggctcgaatacctacaccggggatgcaacactcggatcgtgcattttgacatcaagccacacaacatcctgttagaccaggatttctgccctaagatctctgactttggactggccaagctatgtctgaacaaagagagcgctatctccattgttggcgcaagagggacgatagggtatatcgccccggaggtctactcaaagcaatttggaacaataagcagcaagtctgatgtctatagctatgggatgatggtccttgagatggttggagcaagggacaggaatacaagcgcagatagtgaccatagcagccaatatttccctcagtggctttatgagcatttggacgactattgtgttggtgcttccgagattaatggtgaaaccacagagctcgtgaggaagatgatagttgtaggtctgtggtgcatacaagtgattccgactgatcgaccaacaatgacgagagtcgtcgagatgttggaagggagcacaagtaatctagagttgccacccagagttcttttgagctgacaaagcgtagatatttttcctatcaaatgttgcttccaggtcacacaaatgcaaaatatttgtggagacgagtgcccattaacctcatacaatgtatctgtatgacaaaagtcccacgactcactggacgcggaaatgtcgcttgactacgtcaattttctaaaaagattggcagcaattaatggaggcttatagcggtaactttggtttgcattagtcctaggaatagggttgaatatcgatccaactcgacgtggcttggtcgagctcaagctagctctgctcagctcattaaagaatccagctagagaatcaactcaggtcatttacgagtttgagctggctcgtttaagtcgtaaatcacaacaaaagacaatatatatatatatatatatataatataatcaatactagttaattctagactagtttaacactagaaaagagtaataatactcataatttcacatacaatgtcaatccaacaccaaattaatacacttcatcacttattagttcatccaaccaagtgtaggctttgatttactaacaaatggttgctcgttcgagctagcgagcttgcttgttaacaaaccgagttgagatgctagcttaacttgtgacaaaattaaaacgagccgagtcgaaacaagttgagttcatgacgagttgagcaagctcacaatccacgagtaattttttccagtcctacctaagactaaagtttagtcctagaactaaattttagtctctatctgtttggttctataaactaaacaggttcagaacaaataaaatacactatagaaaaactgaaatacccttctatgattaaggcgtcactaagcgagagcaataaatgaagggtagagagagaaataaatatgctttagtctcttttagctaccatttgagagagtaaagactaaaatgaaaggtcccttgtaggctttggtgttttggatgacaacacaattaaaggtctaattaagatgttaagtgttgagcaggtacttagtgaaaagcttccaaggctcaacacatggagacaagagtgatataccatatataagctgagttggatatggtctatggatatcaggagtcaaagtgaaagattgtcattgatcaagaatttggatacaagaagcctacttgattaatttttctattattta

SEQ ID NO: 638 - protein, 476 aa, Zea mays
MRVNPAPPRLPRLLLGMAAHLPRLPVLLLVLLAAHVVSTSTRAEPPLPSTYNVSMFSESFWCGGIELEWNRTWEDQCGQCEGLGSGGRCAYSQKREFLGCLCSGGKVGNPFCKPSTSRSKRKEAAPIVGAVAVAFLCLVILTSFLACRYGLLPFKSKNKPGTRIESFLQKNESIHPKRYTYADVKRMTKSFAVKLGQGGFGAVYKGSLHDGRQVAVKMLKDTQGDGEEFMNEVASISRTSHVNVVTLLGFCLQGSKRALIYEYMPNGSLERYAFTGDMNSENLLTWERLFDIAIGTARGLEYLHRGCNTRIVHFDIKPHNILLDQDFCPKISDFGLAKLCLNKESAISIVGARGTIGYIAPEVYSKQFGTISSKSDVYSYGMMVLEMVGARDRNTSADSDHSSQYFPQWLYEHLDDYCVGASEINGETTELVRKMIVVGLWCIQVIPTDRPTMTRVVEMLEGSTSNLELPPRVLLS

SEQ ID NO: 639 - DNA, 10479 bp, Zea mays
tttcgttctctgtatcatctccatctccaacaatagcccctaaattcgttcatctacatgtacagtgtcaacaaacttctaaaaactatattatttttcacgatattgcataaaatcccaattttaatttcttatgcttctaaaaataacattatagattttgtttggatctagtaattataaatcatacatgtttagaaatattttactagaactttttaatatacatttgtgccttttttgcattaagaaaaaacgttcatgtacgttgaaattggattacgacgagctagtttgaaacatgctgttgtctgttgagggtctagatctggaagatgggctcagcagcatgcgacacgaggaagtgagtgggtccagatgcacaacaggatagcgggcgacgaatgaaacgctgaattcagcgtgtatgatgctctgcactaaatttattagagtagatataggaccctgctggatggataccggaggctacgatgtactatatgtagtggacagaccgctttagcggctgttgctggaggtagccttatttagggcgtgtttggtatggctccagagtaaaactttgagaaggagctggtcagggcatgctaaacactctaactccagagttgtaaactctatagagtttttggagctacagtacatttttttggagtgcctcttttgctactctgaaaactccaaaaaagcaacatagtcatgaagtttgaagttatttacccgccattgccacctgttatgagaaacaatataaactctggatcagagctgcttcacccggagttttagagtagagctactctagagtggagtagagtcatatcaaacatacccttagaactctagctataaagtcagagtttttaagtttgaatgaaaaatataaataggcccgtgatatacattacagcccagcaaaaaacagtttaaaacccacaacttcgttaacggcagtccgcacgcctgtagacaatcgcatagcgcactaacaggaaaggaagtccaacgataaatgattcagcctgcgtatagcccacgaaaacttccgaccgcgaaaaacgcgggagggcacccacggcggcgtcgatgggagggcctccggcggactgcaccgacgggagggccgagggcctccgcacggcgatgcgggaggaccttaggaggtggtggcctctcggacactcgctgcgacggaacggagaggatcgtgcaaggaggtttcaggtttgctcattggctgtccaaccgtttctgcgagcccgaatcgttccatgtcttttgacccaaacagtccggcttcatgatgaatcctggctgccttatctcctggtgctgggccaatcccgcaggcgaaaggtaggctgattgagaatatcgatttttaaagagctaggatgatcgcgatctgttcgcttgtttttaaggtagtaccgtaccactttctaccatatttttgtctctatagattactacgttgcagcaactggctttaatatgaagcacgctagtttttatggcgtatcaggtaaagccaataacatctaagttaatttgcatacatacatatggcgcgaagtgcacgtcaggcaaccattcgtaagactttaagataattctcaacagatgtttacgagtgtaataacgacagagaagtgactaatggtgcgtgcttataaactattctgcaacgcttgagtgcgctggtcttacttatgggccatggtccaaatcagctcacttcgagaagatttccgcgttttcctttttcaaaaggatagaatcacttttcgtatcatggcctgtgccgtgactaaatgacctcatatgaacacacatgtgaattgtgctggttttctaaagtggtcttcattactgtgatacggtcatacggaattttattccataagtattccaactgtcggtttgccacttgttttagataattaacgggcagggcacgatgaagtctatggtgctgtggttgagtagttgcagtctggagtacagtgttatacattaacgaaagtggcattgcaacgaattcagatcctacttctgcagaccaattttcagaaaagttatctgaaggcatgatcaggggagggaccttttggactacgaagctagtgactgtcccatactagtgcaccatggtgctcacatcatctgaaacatgtaagaatcctgtcaccctcgtccctcttttacattccaaatattttagatgggaaagtataatttatcattcagattgatgatgctcacacagcgtttacttcattgtatttgttgatcagatttacaaagatttgtgggacagttctgtactacttttgacctagaattcaattcaaagatggttaaaacagtcgcaattgtgtaaaaaggcttggtgcctgtcttttactttagtaataaaaaattgattaatgaacatgaaaatcaatgtcaatacaaacgctatcagttatttacacaaaggcttcatattagctgtagttttgtacaaaaggtggtcaaactgagaataaataactatacaggttttcttcaaaacaaaacactactacaggtaaacagtaaacttatggcagtaactttggattgttcatgagaggtacctttgtgtactgttttcaaaaggttatagattttatatcaggtctcacaccaaccacacagcatgtatcacatttcacttgatatatatcaattcagatagtgatcactagtattttttacaagaacagtcatcagtaggatttgttctttcttgttagaccatccaagcgtatatcttggtgtaagtgcttaaaaatgcgtaatgctacctgtgttggactctttgattgagctttggaaactcttaatgcttgctccttgaatggtgcaggattgctaaggtactatagctccttgcaaatatccatgtagaagattactgtaggtcttccctacagtaccttcacttcaaaaaaaaaaatccatgtagaagttcagttcggcagtctctttggatcaaaatcaagaactcaaagaaactatattagctacaatactaatggaagtatttttttgcttttactcatgtttatagaagggtgatatttactcatgggtgtataacatcgtagacatgaccatcaccagggtccaagaacatctgttgtcaccctaattaactttactatattaggagaaggctcttaactgtcagttgcattagacttagacctgatattggccctgtttggcacagcttattttcagcttcttcacaaatttaagcagaagttctgccaaacaggcagcttctgcagcagcttatcagttcagccgcttctcagaatacactaaaaacagccaacaagcagaagctgcttttcaccagcttctcagataagctgttttttcaacaagcagtagctgtgccaaacagggccattattcaatttgtttcactcaagcttatccccatgtttttgcataaaccactcacatgaaacagtgtaaaattgtattataaactcgttccttttaattcacattactagtaaatctcattactatctctacattttgtctaatgtgctgcaaccttcttaaaatgcataaatctggagaaatagcgaaatctatatgattttctataatttacttctactaattccaccaatcttgggccttaagaagtgcatgcttccgatgtgaatttgcaatttttcatgcaactactctctccgttcttttttatttgtcgcattttagtttaaaaatgaactagcgggtgacaaatattcgagaatggggtagtacaatgaaagtaagcacctaactatatttaaattgcaaacaaggaaactgatttaaccaaaattacgagatttaggaatccctgaatctaagcttggatcctgcacatttcagcatgtacatatctagaagttttaacgactgacgagacctgagaatctaacaactcacactctaccggtctacccatatttagagatgccttttcatgctggactaagacgtacacgttcatctacccatgtgcatcctttaaaaaggttaccttacagttcttcacataagtaggcctcatgtgtgatatgtcaatcttgagattctaatatggcataaaaatattatctactacatccgaaaatctggatatatatgtgttacttctgatgtttatatgacactgcagaggttgttattggcaactggtcacagcagaggcagcagacagcagcacaattagcaccggtcgtcgtcagatcacacctctgaagttctctttatattatgaagcctaaatgaagaggacaatctgtttctccagaaacatgtagatgggcaaagtgaaatgcgataatcaaacctgtcttgaaggtcttcactgttgcaagaataagagacaataatatgctacttgtgtctttcttttaccctaagagacctgagcaggtggaaccatgcatgtcacgttgcatacatgttgccatgttggttgagttcaaaagtctaaaacgcggttactagagttaagcgcagatttaaaattatggaagcaagcacgcaccaccaactctaggtcaaggttctctgtgcatatatgagctccaggctgtgtttgtctgcagcactagacaaggagaataaaactcatcatttgcacttcacaccagccaagggctcagcgttaattgccgggaatacattgggagctctgcaatcgcaagctagtttgctgtcaacaacgtgcatcctttgttgagaggccatatcgattagtttgaagacgttgcaagaggccagccatcatggctaagagggatggctacatggacagctcttgtggctactctaatggaacccctaaaaggctggtgcaggatagtagcagtcatgtgcaggcgcatgctaagaagtaagtacagatcatgttatgtacactaaacagagttaagtatgtgcacattatatatactaaacagagttaagtatgtgaaccgcaaatggaattacgataaatatagaaggaaaaatagttagctatgtgtgtttttcagttatttcttttgctccacatgatgttccttgttcttatcacttgtgctattcattttgtttcttgttatgtttccaagttattaatggtcgtactttcctgagtaggaaagttcacattagcacaagaactcagcacacatacgcaccgtatcatgatggctaccagtggagaaaatacgggcaaaagctgatccgaggcagtacctacccaaggtatgcctaattaaccattcaatctttttatcttgcattttttaacaagtggagttaatagttacagactcgtgtaatatgttaattatgttgaagtacgacaattcattacctaagaactactaccttggctaattagcaccgatgcacatcagctgaaatagaacagatccatatataaccagttacatcacacatgttccaactggtccatgctccttgggtcttacagaagcttcctaatatataagggatacaaaaggagcttaaaaacggcagatacattagtgcagatgtatcccttgcctgaattaacatagcaaatccaaatattgaagctcactagctgtaaatagtgaacgttttcgctataatacacgtgattgatcgggcttggttagcttatcttcgcaagcctgaaagctggctttctggtcgcataaacgtagtttaatggaagtgtgtttgggagtacaataaaaaaaatctggtgcgtgtacatttatgatttattaggttgctgtcttcccagtagcagcctgttcctctcaggctgtagcgtaatagcgtttacctttatgttgtcgtgtagctacaagccacatgccagaataggaattttttaaagaaccggaataaagccaaagggggaaaggagagaagagctaagcaccatacgctgacggaatcattacacactctgcttttgtgcgctttgtttattagtgcggaacacgaattagtttcctaattagcatgcagaacttgcttttgagtagaccacggttctgctatttgttgtttttttatacaacatgaatggcctgctgcgtaggactaggttttttatgcaaatgcttaatgtgaatataatatatttcgagagagagtggtagtcatatgggtactgattagacaactgattatggttagtcgtcgattagattcgattagtggagtaatcatgtagtatagatacaaggatagacgtagagtaatgatgagaagtggtttcactgagccaaaagtcctgtgtccgcgtaacctctcaaaaatgaagggggtgttcgtttcgaattaaggccagctgtttaaactgtagtctttataatttataaagacaaaatactgtaaaagtcggtataaattaaagccaagatgaaaggtaacttgtcgaggttatatcccacttacgtgtgggagccgccaacactagatctgtctttttttcatttcatcaagcagtacagagctactaagtcgaccttgcatttgagcggtaacaagatcaggacttgactaggacggaaggagcagaacttcccaacgccatgccttgatcttgccgctgcctgaccagctttatggcccgcaacccctccatgttcagcagctgcgtgtgtgccacagtgccacctcctggtctggtccttctgcagcatctcgagctcgcgctcatggttacgttcccgccagctcatgccaaagacagctgagagatgcttgagaacaacggattcagcaaaatctagcggcagcttagggatggagggatctggtgggagacagcgttgagcggcttgatgatgatagccagcagcgaagcaaggatgcgagccggccgtgcaaggatgagacatgagagttgacagtgctagctcctcttcggtggcacgagcgtgaattctggagtctagtccagaacacaacgatatcttgaaaacctaatggacaaaactaagcccaactgttcaagcataggcacttccgggtattcatccacaggcccctaatcagacaactaataatcatgatttatcgctgatagtcggtgagaaaaatagaattttaccattattaacagtgggcttcgcaaatttgatcgaatttccattacttgtttatagtagccctacttgtatcgaagtgcctaagatctagggcggattaatcgtctgatttaacactataaaggacagtagtacacaagtatgatggatatgatctaatgcttctacataggagtgtaccaataatcctgtagatagatggcaaaaggttaagtttgcacctctgtcttcaaccatcattttgattgataacaacacccaacgctccccacccctctcaaagtaactcattgtctaaaatgcatcatgcttattttttatcactgttgcaaggccagccaataattgaaaatcgggattgaacatcgatcatgaagtttcgagaagagaatcaattatatcatgcaatgccttcaatttgtgcatgggaccagagtcatgtttttagctaggttgatttgctttatgggcttttaaacttggcatttctgccaaagagttagaaaaccgatggaatccataggaatgctgtgatatgtattaactttacacccacatacacggtactaacataggaaatggaaacttttggaatggtgcaaattctcgcagcaagctaaggggacacatttcatatctggcagggtagcaaaagaccacgattagtatatatggatgcaagctaagggggcacatttaatattaagtacgtcggcctcaacgtaataagtacatcgaccaaatacatcggttaatcgacgtactaacctaagtacgtcggtatattagagtaagtacgacggttccagtttgacattctttaatcgtttttctgtagtgaacctctttttttattttttatttttaaggtaactagtagcattgaacgtgcagatcacatgtatgagtagtgttgcataaacaatttttgtacacgtaagtgttatgaattgaaatttgcttttgtcaaagttattattgagttagtagtcgaatctagattagctatcagttaccaatttttcttattttaaaaggggagatataatgcaagtgggtctgggaaatagataaaccgagtcaagccttgttcagttaatcatgttatccatagattggataggattgaaaaaaattaagaaaaagtttgacttgcttgggatttaaacccactcaatccatatggattgagagctaaccgaataagctcttaattgttttctcgcaaatgtggagaggctatgccaagtcttctctcatgcaaaatgtgtactgttcacgctgggcccagtacgttgacttgactttgggcccaacaccttcatagtttgtcacagttatttaggcctggcatatatactaccacattatcagtaagtattggtgacgctagatcctcagtaagtattggtgacgttagatcctcaagtgtatgcatgtgataccagtacctgggaaaactcccggcattggggtatgatatccagagcatgcctgcattggaatcctcctttggagctaataatgcatgtcggcatgattaactattctgagccaggcggacaacgccacgtgttctcatgtgtcaagtttttcggcttttacaggcatgcatgtatgcatgttggcgacctcttttttccctaggtcatggaaaagtgaactctaaactactcttgatgtctacacatgcaggtgctactataggtgcacataccaccaggatcatggctgcccagcaaccaagcatgtggagcaaaccaattcccaggacccgccattgttccgggtaacctacacgaatgagcacacatgttgcagcgcccatgtctcagattacatggcttcatctgtacacatccagcagatcgccgatgcttctttgagaaagctagcagatgtggaaataccgagcctgacccactgttttagtggccatgaattgataaaagaagagaatgatgccgtcatctcctcattgctcacggccgtcagtggttgtgatgtggcaacatccgatggcgtgcatgcagccattcaagagaacacacctgctcggatgtcccgaagcagcaatgaggctagctcttcgatttcaccacctgtactgttgccggcatccgataacccgaaaacagacttcatcgagccactggagacccaatggttcgagcctttggatttaggttggttcatagaataaactgactggttgatctatcatttattatgttggtactaaacagtaaacacatccataaccatcctgcggttctgctagaaaatatgtaattgttctatttactgctagagctctctctctatattttgtttgaaaccatacgtatatacttgtttaatgatccgattttttttgtgaaagtaacatttaaagtggtttagattagaatagtagaggcgagtacgccacatgagaaaagtagttagtaaatgtttgcttcaccaataataaaaagggtaaatacccactagaagatatctatcgatagtactccaggactattttgtttttttctgtagatttctaaaatctatttttggattgtagattttgaataaatgaattttacaagctgagattattgttcatttattttggatgggctggtccctggtcggcagttttccctgtgtatatatagtgacgatagctattctgagtgtctacattttttgtgcttttcaaaaaaagatatctatatattttgtagttttgtactatgattccagctatgcgcctatgcgttcctattattgtttctaaaatctttcttttcacgataattgatactcccttcattcttttttatttatcacactataaatattcaagaacagagctagtatttgataaggtgttatgtacttggcgtcgtgaccagatatgatgcgtattcgcctcgtagctggttaaaaaacataacccgaaaaatgtatgtaaaaaatatacataaagccccatataaatcataaaaacaagttttctatgcttttcatatgaagggacgcaaaacaaagaattagcaatattatcatggtagcttatgattatgatgcgctgccagtgcttgtgcactccatgagctactccttcgcttgccccggacttctaggttctctttatgatgtgtttgattttaggttaaagtagtgtaaggcggaggcgatatcgtcccctcaattttttggatcacgttgccaccaaaaaaatatttcggtgtttacctcgccccccccccccatatgactctcatccaaacactataaaaactgtgaccgtctccttcca

SEQ ID NO: 640 - protein, 240 aa, Zea mays
MAKRDGYMDSSCGYSNGTPKRLVQDSSSHVQAHAKKKVHISTRTQHTYAPYHDGYQWRKYGQKLIRGSTYPRCYYRCTYHQDHGCPATKHVEQTNSQDPPLFRVTYTNEHTCCSAHVSDYMASSVHIQQIADASLRKLADVEIPSLTHCFSGHELIKEENDAVISSLLTAVSGCDVATSDGVHAAIQENTPARMSRSSNEASSSISPPVLLPASDNPKTDFIEPLETQWFEPLDLGWFIE

SEQ ID NO: 641 - DNA, 3 bp, Zea mays
  misc_feature (1)..(3): n is a, c, g, or t
nnn

SEQ ID NO: 642 - protein, 980 aa, Zea mays
MEAALLSGFIKTILPRLFSLVQGRYKLHKGLKSDIKSLEKELHMIAVTIDEQISLGRKDQGAVLSLSIDELHELAHQIEDSIDRFLYHVTREQQASFFRRTVRSPKTLLSRQRLAAEVQFLKKIPEEAHQREKRYRVFAGLSSSTRHTESSSCSSVSDPHTLKADVVGIDGPRDELVQQLTEEAEGLTKQLKVISIVGIHGSGKTVLAREVYESDVGRQFSLRAWVSATDRGPREVLMEILRNFGRPVVDSSSIDQLTVDLRKHLGEKSYFIVIDGMQTDQWSTIETAFPENNVVSSRVIVTTTIRSVANSCSSSNGYVHKMKRLSDEHSEQLFIKKACPTKYSGYTRPESKEVLKKCDGQPLALVTMGQFLRKNGWPTGPNCENVCRDLRRHLEQDDTLERMRRVLIHSLSSLPSHVPKACLLYFGMFPCDHPIKRKSLMRRWLAEGFVQTQPSSSENFNTLIDRNIIEPIGICNDDQVKTCKTYGMMHEFILLMSTSHDFITLLCNNKVEHKYVRRLSLHHHSATSGSFSVIDLSLVRSLMVFGEAGKTILSFRKYELLRVLDLEQCTDLEDDHLKDICNLFLMKYLSLGETIRSLPKEIEKLKLLETLDLRRTKVKTLPIEVLLLPCLLHLFGKFQFSDKIKITSDMQKFFLTGQSNLETLSGFITDGSQGLPQMMNYMNLRKLKIWFERSKRSTNFTDLVNAVQKFIHDDKESNDPRSLSLHFDDGTENILNSLKAPCYLRSLKLKGNLLELPQFVISMRGLREICLSSTKLTSGLLATLANLKGLQHLKLIADVLEDFIIEGQAFLGLLHLCFVLERATLPIIEGGALPYLISLKLICKDLVGLGDIKINRLKCLKEVSLDHRVASETREIWEKAAEKHPNRPKVLLVNSSDESEIKAVDCSVASRPAVSEANGTSPMSEVDVREDDIQMILNQGLSAAAEKQMNCAVQPSSKAELNSDFNNISFPEVALGLTEL

SEQ ID NO: 643 - DNA, 8448 bp, Zea mays
gctgtgcgggagtgcggcctgcgggagtgcggcctgctcggttgtgttattaaaatatttgttgcagacatgagcacaaagctcatctagcccacttggtagagcacaaggcttctaaccatgtggtcgtgggttcaagccccatagtttgcattttttttgtttttttgtttatgtcgtgggttcaagccccatagttccgcttaaatttatttctcgcctagatttttttttcacaattgaaaaaatcgacccaaaatatatgctcatgtactgatcggccaatatctctgtatgtgaaaggttgtggagaataataataagtagggcatgctgtttatcaaagcaaatgtatataaggaagaaaaaaatgtataaaaatatttatagtgatttagaaatagttaatgattcgtaatgcaaattttgaataatgcacggatgacattttataaaattactacattgcttttgtattgcacatgcatgatttgagctagtcgattatttacgcgcattttaaattcggaaactgtagattgaaatgcgcgcgcatgcagtgcaagtatggaaggcaacactaggcacaacgacataaaaaaatctaggcgagaaataaatttaagcggacacaccaacgacataaacaaaaaaaaacaaaaaaatgcaaactatggggtttgaacccacgaccacatggttagaagccttgtgctctaccaagtgggctagatgggctttgtgctcatatctgcaacaaatattttaataacacaaccgagctcggcgccaagatctgtggcgccgagctcggttccacgtcgacgccacgcgtctgggttgtgccaacgcaacacgacctcggcgccatagcctatggcgccgagctgtgttagctcggcgccatagcctatggcgccgagcaaagggtccaaaactgcatttaaaatttttttaggtctaaacgtgattttacttctgtttaagggctaaaatacaaaaaattcggtcggtccgtaacgtgcactctgcactctactaagcgctagtgtacgtacgtacgtactccgtccgctgctatattatggccggccgtggcgtgccctctctagccagcacagcacacacactggaaagtgcaagctgtagtgagacctgcgcgactgccagcgtgtatccgcgcggcaaggagcgtagcgcgcggtcgtcggcccgcacggccaccaactcccttggacgcacgcgcgcgcgcgaccagctgctaaccgtgcgcaagtagtagtgcgacttcgccgccggccgggatcgctagctcgatcgatcggcgggaccacatacgactccggtgtggccagcggcggccgggccggggaacgcacgtgctgcgagcgagcgagggcagacgctagctgttgccgggagctagccggcgcgcgatggggagggcgccgtgctgcgagaaggtggggctcaagcgagggaggtggacggcggaagaggaccagttacttgccaactacattgcggagcacggcgaggggtcctggaggtcgctgcccaagaatgcaggtaaaccaaagccggccgcgcgccatgcatcgccacgtagcatcaatctccgatccatgcatatatgagcttcttcttcgtcgccgtcgtcgttcttagctagttaggacgcgcatgcaggcctgctccggtgcggcaagagctgccggctccggtggatcaactaccttcgggcggacgtcaagagggggaacatctccaaggaggaagaagacatcatcatcaagctccacgccaccctcggcaacaggtaacaataagcgcgccctaatctcaacgctgatcactgtgcatccgactagagagtagtagtactactacttccttcctttatgcatgggagtcaatgcacgcagtcccaaaaaacttggtatacgtacttcctccttcacacgaagaacggaaatctagtccaacaatatcaactttgatcaaggcattcatatatattatgaaatatattttataagaaacttccataaatatataaatgttgatagtactataaatatagttgattgagagagttttcttaaattgtgaggtaccatgtatacttttatatatactacttaaacgcttctcgacgtacaaatttggggaaaaggatctctggcacaagactagaacagtcagcacagacaataaagggctactccgatgaaaatctcgttttcattcataggagtatagagtagtgtagtaacaattgcctgctctatatgctctctcaattactgaaatcttagagcaaatattgagattgatgagagagagagcagaatcggactgcaaacttaaagtcggggcttagacacagaactaaaaactttttttgtgagaaagacatgcaaattataaattaatagtgaagagctaaccactacacggataggctaatgtaaatcataaattaatagtaaagagctaactactacacagatagactaagaagtagactataaggttccttacttataaccagcggttgactatattattaaacttgatcttataatttcgatagctgccccgatcggttgagagttaagacaccgtataccatacacgtacacagtactaaataaagaattaaatgatgtaggggcacacgctgctggaatagaggcgcgcgcagcaatagtaggctaatgtcctttttttctatgcatggtatgggtcccgatcggctttatcactgtttagctactgtagtgataatgtccaaaaagatggtttcatcagcgaaagacaaaagagagagaagagagaagagagaagagagaagagagaagagagaagagagagagagagagactcctataaagagtagtgttgctatagtgctagaatggtgcatattactacagtgcatatatgtgagaaagagccggagctattgagctaatacaatctatagggcctaaattaatagagacatggctgaaaacaatatggccatctggtccctccgatcgatgtgctgtagtatgtttatgtacacgcgggctctacgcacgcttgctctagcattgagcagtgctactttactacactactatcagtccggtccttgtcagtcactggctcagcatgtgtctctgaagttgcccgtacgtgtggcagcagccaaaagggcgtgctgcgtgtgtaagtttactgtccagtcagatgcgtgtgatttccgaggccacgtgcacgagcatgcatggcgccaacatggcatgatgtgatgtttgtttcggccttttttttagattttggctaccaaaatctggtacagacagtcaaatattcaatttttagtccacttctataaaaatcgatttggtaaaaatcatccaacaaaatcaacataaacacaaaatcggtcggacgttgcaatagtaggaatctatcactttctagattgttaaccctatagacacattaatcttcctccgcacataatcctcacaatactcatattctctctgcagccaaattcttttaaaaaactggtaagaaaaaagatgaaccaaacaggctcgatgatgctcgccacttcttatgacttcgcatatgtggcaagaggggcgaaataggttgctaactgtggatgcaaatgcaccctgtaaaatacaatttctataaattcagtcacaatttcactatatatgcactcctagaaaaagttcttatctacccacaagactaaatacaccctctcaattataatctagcttcgctattatgtggtaatgaggtctaaaactagggggtgtttggtttatatggactaattttagtttctgtatttgacaatttaaggactaaaataaaataaaatagataggctaaaaattaatctttagaaaccaaacactctctaagctgatccgtcatatattcgttacatttcatctctaagacgaaaagcagcagcacgaggaaatgatctaggcactttctcgtgctcaaagatttgtgcaactaagggaagattagaaagctactactgagcagtactgtgatagcgtcatgcgtgcatatacacacacaccttccactccataaaatgcagggttttttttgctccatcagttttgtttaacctattttttcccaagcaacttctttgattttgaccagtggcgggacgaaagtccaggtgaggccaatccgtaataaagaaatcacaagaaaaaatgctaaactataagtggttttttggtaatagcatgaaattaagttgtaatatcatgactattataaaataatgtggatatcgaaaatctttttagcgacgccaaatcatcgatagaaaattcaatctacaattagaagaaaaagtattaggtaagcatcaatgtaagtaaaagacaaaactatatagaaaaaacatcgaaaacaccattaaaccatcaatcttgtggttgtggcagcttgcactctagtgcggggccgtggccgagtggaggcaggaagacgagcagcaagctagcgacagtgtcctgacagctggcgatgacggttgggtgggcggccaacgatgatgaactgactgttggacgtcaattggacagcgggcacaacgctaggacgagcgctaagcgggggttggatgctacaaacgtgcggttgatgcctttctcattctgtgttttattcgatataggtcgtgacctaagatgatgggctagatcttgtgggttagtcgatggtatgatgtggtggacccggtgtttatctaatttagtcgcatataccttatattttttattttatagtatatataaaaggtaggtataaacagttccaaaaattaaggtggcgccatggcctactttgcccacattgtggatccgcccctgattttgactgaacttggataaaatatactggtcatagtatttataatacccaaaaaaacaatgtcatggcatttattaacaacgggttttcattaaattaaactgatttggtttgccgtaaatttaggagaaccaatatgatcaatgagtagcgtatatcttacagtacagaaaaatctttgaaaaaaatatataaacagcacacaaaagcatgcgattcgtcgacagcatcgtctcacggtctcaccacaccattcaaggacgatggagcttcttcggtgctcagactttatttctaccatctacaacccaaactgatatgtacagtaaatggaaggaagaacaagatagagaaaaaaaacccaaactgatagattagaagtcgctgaagaaatcatctaacaaaactggcgagctatcaaacaggacacgggagagaatagatgattaaacaataatccctcgtgcaatgcatgccactgtagcgccgtaatataatgatagatatgcgctattgctcctacaactacaacccacatggtgttgcgagagctagcggtgccacacagtcatggaaacatggtttgtgaaagcagcttaactaattactagctagctgtgagtcgtcagcggctagcggagagtgagagtgagaggaccacgcgaaagaaacgacaataatctggtccaacactcgctcttcattcaagctagctagcgctgggagcgaactcgcgtcgcatggcagagcctgcctgctgccgagcggacaggtcacggtcttcttgacgcacgcacagtccatggcgttggttggcgtcctgtccatttcgctttgctgcctcgccatcaccgccggccggtactgtgcaaagcgcgcattggctagcttccctgttgccttgatctgatcatagaggggtccctgtccgtggcacacagtgggattaatgacgggcccacgccggccctccctaatgatttcccccgccttaacgttgacactgcggacggtgagaggcgcggctgtggacgtacggcgagatctatcgggggcccatcgtccttcgcgaacgatgcgtacatttagcgccatatataaacacacgccggcacatgattactacggcctatatacgcgcgtcgtgagcggcgcgatcaatgagtgagctagttcgttgcaccaaattgtcgatcaagttgcatcagacagtagagtactgtatactctctctatatatatactccctccgtttctttttatttgtcgctggatagtgcaattttacactatcctgcgacaaataaaaagaaacggagggagtatgtactaggcaggctaagaaacacgatagataccacgcattcggttctcattacgaagctgcagctgcccaaccagcagcgatgatcacgtacgctcaccatcctgcgtccttgcggtttaaattaattacgtatgtatccgcatccgcatgcaggtggtccctgatcgccagccacctccccggccgaacagacaacgagatcaagaactactggaactcgcacctcagccggcagatccacacgtaccgccggaaatacaccgccgggcctgacgacaccgccatcgccatcgacatgagcaagctgcagagcgccgacaggcggcgcggcggcaggaccccgggccggccgccgaaggctagcgccagcaggaccaagcaggcggacgccgatcagcccggcggcgaggcgaaaggcccggccgcggcggcgtcgagcccgcggcacagcgacgtggtgaacccgggcccgaaccagcccaacagcagcagcggcagcacgggcacggccgaggaggaggggcccagcagcgaggacgcgagcgggccgtgggtgctggagccgatagagctcggggacctagtctggggggaggccgacagcgagatggacgccctgatgcctatcgggcccggcggccacgactcggctgccctcgaagggcttggcgcggtcggctgcgaggcccaggtggacgacctgttcgacatggactgggatggcttcgcggcccatctgtggggcgggccggagcaggacgagcacagcgcgcagctgcggcaggccgccgagccgctggaagttgctgctgctgctgctgctgcgacggcggcccgcaccccggacgatcgcgagctggaggcgttcgagacttggctcctgtccgactcgttctgacggctccggtcaccggaccgatcagacagaccaaccaaggtggcccggccatatggtcgacgccgctagtaggcgttgctcgtgtgtacagtttttttttcttttttgtagattttgttcttagctcttgctgtttcgtgtatggcatgtagaatagagagcagagagtcgtatggcattgtaaaggtagttctccgccggtgaagtgaagaccaataaaaaaaagcagcgcagcagtaggcgctgctgcagcctgcacggcggcgttttggcagcgcgtgctttggctttttgtgaacagtgatgggaatgttgttccttctgccctgagtcctgaccgacagtctcctcgttggagaagaatgtacgcggagacccggcgacagaacgaatgagtgagcagcgctggactgtctccgagctgtgaaagcatgaatcagtgcgccgaactttcactgctctgctaggcacttgctactccaactgttacaacaagcacccatctgcgctgcgctcgtgggcatagtgagacccattcctccttcaaccaaggggatagtagccgacagcaagcaatgacacatggttttcgtgtccacgcggaaaaggccagtcagtagtaccgtgtactgcgtacaacctgataagctctgctcagcgggactcacagtgcatgtcgcccgacgctttcgccgtcggcgtgggtaaccattcaccagcacttcacgtattgcctgacgatcatatcatatcaagcaggtcgtcggtacacacgacggcgggcaaaaatgaaggcaggattcgaagcgacgacgcctctgcccgagcacgttctcccgtcgtcaggtctcgctcggcagcactgcacaccgccagtggcccggctccatgccggcccaacccaactgcgaactgtcaactgcctgccttgtattccggtccgcgttcggttcggtggcctgtcagtgtccgcgcagccaaaacagtcgccgcgtgcccggcacggccgggggggcaggccgatcgcgcgtccgggtcgcgcgattggcgcatgtgttgtggttggggcaggccgcaggcatcagcatcaggcttcccagtcgaaacgtctcgctctcggagtgttcccggcgtcagatcgatcgatgcatccatgttgtttgtcagtcgatttgccttgccgccgttacattacattctcgccagcctagctagcctagagacgccgcgcgcgtccgtgatgaattaggctcgctcgaccgaaagcgaggtgtggaatggggaaggcagacgatgagga

SEQ ID NO: 644 - protein, 376 aa, Zea mays
MGRAPCCEKVGLKRGRWTAEEDQLLANYIAEHGEGSWRSLPKNAGLLRCGKSCRLRWINYLRADVKRGNISKEEEDIIIKLHATLGNRWSLIASHLPGRTDNEIKNYWNSHLSRQIHTYRRKYTAGPDDTAIAIDMSKLQSADRRRGGRTPGRPPKASASRTKQADADQPGGEAKGPAAAASSPRHSDVVNPGPNQPNSSSGSTGTAEEEGPSSEDASGPWVLEPIELGDLVWGEADSEMDALMPIGPGGTTRLPSKGLARSAERPRWTTCSTWTGMASRPICGAGRSRTSTARSCGRPPSRWKLLLLLLLRRRPAPRTIASWRRSRLGSCPTRSDGSGHRTDQTDQPRWPGHMVDAASRRCSCVQFFFLFCRFCS

SEQ ID NO: 645 - DNA, 2572 bp, Zea mays
gctggagtccttatcccatgcgtggttatcctaacaaactcggacggaactattggatctcgcctaggaatgggtccaaacccccctatatacatgataggtacgaccaaatgagaatacaagatcaaatcgaaaccaatttattacattatttatcttcatgccttaggagtagatgtagtgtagctctagttgtagtttcccaaactcaaccttgacctctttagctctacgtcatctagaggtgctttaggtggcttgttgatatcaaaacaaccctatgatctcttctccccgacggggtcctcgagagacgatatttaggttctacacaaaaccctctacggcatcgtggatggtccaccacctacaagtggacggtccacgcgcctgcagagaagagcatagttatttgctccatggtgacctacacgcgaacggtccagtgacctatcacgaaccgttcagcaccttgcagagaggtctccaaggtctcgactactcatgagcggaatctagtgattattggtgtttagcgcaaaaacggcgccaacagtagggtttacgtgcgaagtaagatggagggtcatagagtttaagatatagaaattgacagattcctcctattgttggataactcggcggattttgttcagattgatttagaccattttcacacactatcagatgccgatcctagctaatggccagaatctgagaaacaaacaccccgaaacgtacagcggtgggcgaggtggttaggtcactgttcaccgagttttgataagtttctgtccgcgtcagcgccagctacgcgcgctggaaaatgctgactattttggctgcaagcatgggataaccatggattttttttcctgcagtgttgctatctgttctttgtttcgtagtggctgtttatcctcgtgtgcctcgcgtgcgtatatacacacacgtcctgcctgcacgcaacgcagctctataaatacctcatcaccggtgcactcgcttaatatatatccaacaaccagcagtgcaacaagcaagatttacctgcccgtgagtgtgcctttcaataatataatgtcttattttattattatgtttttgcagtgatagtagtctgtaataaatctctcctttcaatatatataattcacatgccagatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccgaataatggatgtgtgaattctcactaattaagtaatgcataaataaacgtattcaaatgtcgccccttcttgcacagtgaatatattgtgttgacagcaaaaaaaaagtatgaggttaaattcggtacaattaattatgggcctatttggatcgtcaccggacgaaagtttagcctaacgttgactaattaagaaattctaatgagttctactcatcaattagcttctatttgttcttgttaatttatgtttagatcttagagttggcaaccgaagtatgcagtaaagtttagtccaaacatgccccgtactgaagataggatctgattagaaaataaagtgagaaaacatgcgtcctttgtgttttctcttaatatgtcctaaaatctctagaatgaaatatatcacaggggagaggaattagggtatagatcatctgcaagttttttttttatccaccggaaagtgaggttaccaaagtggggttactattaggaggttgcagtaagattttattaaaaatcgaagggcaggagttctatatgatttcccccctactaattacacagtagacgcacatgcataaacatacgcacgcaaaccatatatcataccaacgttgtagcagtcatcgtgtcgactaaatcaacgtgtgttagtgcttattatagagccttgtgtcaagaaaccattatttcaaaccttgcagcatataatttacaagaaatctgtatatatcgattgatggtgtatatatagctcctactttggttcttataaaacacaaacaaacatctgaaagttggcaatttgcgtgtatcgccgatctggatatcaaatttccatttattggtgttattgaattctacaagttgttgtgcttcatgaactgcattggaatattagattctgacggatattacattcgtataaatgctgacgagttgtgtaaagtccacatgataatgagttcatcttaagtgaccatgcttccgagatgctgatagttagtgctgcctaacaaatcagaatgtgcttccaagatactgatagtgctgtcc

SEQ ID NO: 646 - protein, 73 aa, Zea mays
MSSTECGGGGGGAKTSWPEVVGLSVEDAKKVILKDKPDADIVVLPVGSVVTADYRPNRVRIFVDIVAQTPHIG

SEQ ID NO: 647 - DNA, 3864 bp, Zea mays
ttgggtcgtaggaagttagctaggggctatagttagtcgtaggaagttagccagctaacttcctaggggtacagtcagccgtaggaagttaatcagctcacggcgctgacggcgtgaagctactaccttccgagaacctagtaacttccgagaggcttctttggctgtaggaagttagctaacttcctagagggctctaggaagttaagctaacttccgacaaaaaatttccgagagccaaacttccgacgggatggcttaacttccgagagttcagctaacttcctagagtttaggtctaactttctagggtttaggctctaggaagttcactattttggtgtagtgactacacattaacaacattaatatataactagatattaacaagacgtcatcacataaaaaaaatatgaaaccctaaaaccaaaaaaccaaatttagagactaaaattactagtagcgggtccatacgttttcctattttttaatcgactaaactaaattaaatttagatatcatgtatatcagattactcactagaacatgtagtattttaatgtccgacagtttaggccttattttcgacgactttggctatcggaaattttatatttcagtgttgtgttgcattccaatcctaagagcacgatttcagattttggaaatcacttttattctctagcttcatcataccaaggttagcaactgctgcttgtattgcttgcagacgtgacatcgcctcaatctccagtgcaacttcaacagcatccatttggtctgtaacagcaaaacccaaatcaacgtctccgcatgcatgcatgcatgcgggcagccctctgtttaagacgtgcgtcaaggtcctcaaggatatataagatggtgggtccggttcgttcgttcgttctcgttgcctggcgcggctataaaatggcagctgcggagctgccatctttgcacgaagacacacacacacagcagctgagcagcagcaacacgctcccatcatctctcgccatgcgcccaacacgctcccctgtgccggctacggcgctgctcctgcttgccgtggcactggcactggccgccacggcggcggcccgccacttctacaccaccaccaccaccacccgcgtcccggcgccagcggagcgggcggacgaggaggtaaggcgcatgtacgaggcgtggaagtcgaagcacgggcgcggcggcagcagcaacgacgactgcgacatggcgcccggcgatgatgagcaggaggaggaccgccggctgcggctggaggtgttccgcgacaaccttcggtacatcgacaagcacaacgcggaggcggacgctgggctccacaccttccgcctcggcctcacccccttcgccgacctcaccctggacgagtaccgcggccgcgtcctcggattccgcgcccgcgcccgccgcagcggcgcccgctacggccacggccacggctaccgcgcccgtccccgcggcggcgacctcctccccgacgccatcgactggcgccagcttggcgccgtcaccgaggtcaaggaccagcaacagtgcggtccgtagcatatatactccgacccatagcgcgccgtactcttacatatgtgtgcgtgctctccggcgagaagcttgttgcggctacttatctgatgacgatctctgtggggggcatgcaatgcatgcatgcttgcaggtgggtgctgggcgttctcggcggtggcggccatcgaggggatcaacgcgatcgcgacgggtaacctggtgtcgctgtcggagcaggagatcatcgactgcgacgcccaggacagcggctgcgacggcgggcagatggagaacgcgttccggttcgtcatcggcaacggcgggatcgacaccgaggccgactaccccttcatcggaaccgacggcacttgtgacgccagcaaggtcggtatgggtgctggcgtgctgctgcttttgcttcgtcgatcgatggatggatgatgcggtagtactgctgctaatataacggagagatcgatatgactgtgtgtgtacgtgttcaattcaatgcaggagaacaacgagaaggtcgccaccatagatgggttggtggaggtggcgagcaacaacgagacggcgctgcaggaggcggtggcgatccagcccgtcagtgtcgccatcgacgcaagcgggcgtgcgttccagcactacagttcggtaagctagctagctagctaagcatgcatgagaatgagatccatcagacgacgacgacgacgaccgtcacagatttaggaagaactagctagctaggttctgtgcgtgtctgtctgtgtgatgaactgttgtagtatgcactataatgcagggcatcttcaacgggccatgcgggacgagcctggaccacggcgtcacggcggtgggctacggcagcgagagcggcaaggactactggatcgtgaagaactcgtggagcgccagctggggcgaggccggctacatccgcatgaggcgcaacgtgccccggcccacgggcaagtgcggcatcgccatggacgcgtcctaccctgtgaaggacacctaccacgaccccggcaccggcaccggcaccgccacggctacggcagctgccatggatgtgatcaagatggttcttgcttaggagggagcgagcggagcaggcagcagagagccgatggtcttgtcgtgttgaactttacatatggtagctaggtaccactggggataattaagttaatccgttatggtgtggcaagttaattaatatgtgcgtatctcttttgatgagtgccatatatgatgtaatgaagttacataaactcaaataaagtcgtaatcgtaatggtaaagtttgtttgttggtttgtcaggcgggggagtatgggagtgcagggacagagatgttgtgcgggcgtactgagcgcgtatggagctagagcgaggcaatggagatgactgatgaggacatagagaaagccgacacacttacggcctcgtctccggcgctgtgtttttttttttggagccaacaattatggttagtttggtgcgaacctggatttggaataaaaaattatgatttatatctctatttggcatgtgttctattaacttagtttagtgcggatataggtttagagccaacaattattcgtttgaatctcatttagctttttaccgattaaatgtctaaatatggatccagatcagagggacaacggctttgttaaaaagcacaaggttttttttatactccactattccaatttataatttgtttgacctttttctctaagttttactgtcttgtcttattcaaaaattttcataattattattaatttttactccgatattgtttagcatatagtatactttaagtatggttttcaattttctatttttcacaaaaaaattgaataagataagccaaccaaatttgacaaaaaatcaaaagaattataatttaagattgagaaagtataaaaaattaagatggtggagtggaaccgtagaataactgatgttttaatatggtaaagatataaatatatcagataaataataaatgaaaaattgtaaggacgcactttaaaatatgtagccatagttgtcaaacgtcactaaacaataacttaggattaatttagtagacgaaaaaatgaagaagattaatagaataaattttcttactatttaaaattgaatagggagagcgaacgagcgtcgtggcttcacgtggcgtgggttggacttggatgtggactaccacgtgcagccaaagaagtactggagcttccaacagtctaagcagctatgtgggtccatttggcatgctgggatatttat

SEQ ID NO: 648 - protein, 398 aa, Zea mays
MRPTRSAVSATALLLLAVALALAATAAARHSYTTTTTRVPAPAERADEEVRRMYEAWKSKHGRGGSSNDDCDMAPGDDEQEEEDRRLRLEVFRDNLRYIDAHNAEADAGLHTFRLGLTPFADLTLEEYRGRVLGFRARGRRSGARYGSGYSVRGGDLPDAIDWRQLGAVTEVKDQQQCGGCWAFSAVAAIEGVNAIATGNLVSLSEQEIIDCDAQDSGCDGGQMENAFRFVIGNGGIDTEADYPFIGTDGTCDASKEKNEKVATIDGLVEVASNNETALQEAVAIQPVSVAIDASGRAFQHYSSGIFNGPCGTSLDHGVTAVGYGSESGKDYWIVKNSWSASWGEAGYIRMRRNVPRPTGKCGIAMDASYPVKDTYHPGTGTATARAAAMDVIKMVLA

SEQ ID NO: 649 - DNA, 10506 bp, Zea mays
tctttgctgagcaaccagaagagacttcgtgcctgtgttggcaggaggacttccaaatccacttgaaggcatcatgaacttggtggtggctcccaaatcccaattagcttcttgtatatattggcaacggacaatatctgagctcccaatagtgatccaaatatttgtatcggtgtatttgtccatacgcactatctgctcgtcacagcctaagtgttggtgctcggttgcacggcatgattatcgttagcatttcattagtataaagatgggtgaaatccattaggtctcgtttgtttcctttcattttgaagaattgtaatcttaatattggaatagactattttttaaaaatatgacattccatcaatttctaaaattatcatataagcctatctcaaattcatgggtgagagatagaaattgattctataaatttagaaactacttttttgatgtacaacttatagcacacttttctacttgcttcgttataacatgaatatagcatataactacctctcatatgatttaagataatatacaaatatattacatatataaatatatgaatttaattaattttatctaaattataattattaaaatggaattcaattccaatgaaacaaacgggcttgtagagacccgcttcaactaagataactcacacggtgacccagcatttcgttctctgtttgttggatgcactgatgcatcagtttaagtggtggtggtggatcacgcgcctcgcctgatcaactgagccttatttgcacagagatttcacaggctctcccatcgtcggttggtgcgcgcggcgcgtctggcgtgcagcggcggcacgacacgcaactagcgcgaggagggcgcggcagcagccgctccagtcgacttctccgacgtggtctcctcccacccatacacccatcccttcccctcccacacaggcacacacacacccacagcacccaattccctcgcgctccccctctcccgcatcacacatcccaccgccgccgccaccaccaccacccgccctatacccgtatataattactcgtacccggacgccaccgccgcctgcgccatgggcgactcctcggtggccggcgcgctcgtgccgtccgtgcccaagccggagcccgcgccgtccggtgacacctccgcggcggccgcggcgactacagcggcgctggcgatgccggaggaggcgggtatgcgcgcggcgtcggcgtcgcctcaggggcctgcggaggagggggagggccccgccgatagggacctcctctgcccgatctgcatggccgtcatcaaggacgccttcctcaccgcatgcggccacagcttctgctacatgtgcatcgtcacgcacctcagcaacaagagcgactgcccctgctgcgggcattaccttaccaaggcccagctctaccccaactttctccttgacaaggttagctgcctgttctagttgcctcggttacttttatagaattcgtgtcatgtgctgcaactgcaaactgcaaactgacatttgctgaatgcaatttatgtatcgcccgctgtggccgtggtgtggcaaaaacagtaggtgttgcatgcaattccgaattctactgtttcgcaatgaaattccattcgatgggtcaacacttgcactgccacattactctgatctcgatgtggtttgtatgggatgctgctgccattgggctcgtcgattctcggtttaccccttatttacaccgcagtattagaagtttggggtagcttctgtagtacatgttcctcagtgtccgtgttgaccagttgatttcctcatacatttcagtatattgttactgatagacttttcagaattgcttccacaacttctagtgctccatgtctgttaggtagtatgcaattactatgccattcatcgctatgtgttcataaatctatgttactggtatgcacttatgctattgacttttagcattactatactcaggcccttactggtataaacatttctgtctgtctattttttatttagaaccgattgcacatatgacttgctaaatttcttacattgcatccttgtcctgtatatataggttctgaagaaaatatcagcccaacaaatagcaaaaacagcatcgccgatcgatcaatttcgatgtgcattgcaacaggtcagtgattccatgtgttactttgctagttgctactattttcaatgataaaacaaactccactcctgcattcaccacttaacaggcacattttaagtctctgcatcgatcattttccttgcatccgcttttgtgtagcgactacatttgtatatggcagcccagcagctctaataaaatcagctagtttgtttggatggataaacatatcagtttgttagtctgagatggagtttagatggataagtattggtttgttagataaggtttgtcggctgagatagagtttagatggataaacattggtttgttagatcttagataaggttggttagctaaggctgctatcttagatggataaacactgttcatccacgtgaacagtaccacgttcccccagccagcagccttaaccctaggacgataacgcccaagagttgggatcctggttctcgacctctcacccaccacttgtactacctctgtaaccctagttccaacaatctggtatcggagatgtcaggttccgacgacgtgccgccgaagtcagcaccacccaccaactccaccgttgcaacaactattgatgcgagggctgctgccaccagctcaattttctaggcggacttcatggcttttcagcagttgatggtgtagcagtttgccgccctcatcgcctccatcaacggcatgtctagtaggacaccgccaccaccgacgtctctagcttctgccaccaccagtgctgctgctttcccctatggcatgttgagctatggtggcatacccccccttcccaccatcgccgcgccatccaccaccaccaccattgttcccttcccatctgccacgacaccccttccatcaccgatcgccgccttggtgccactggcgtcaaccatgccctgacgctcgtacccatccaccacgtcgccttcccacactccccatccccgatccccagctttcccgaggatgctcttcctgcagaccatcaccctgctatgacctgcaagcgccatcaccaccaccccacttccacaaattatccttctccacgttcgacgggaaagatgacctcgtaggctggttgaaccactgcgagcatttttttcgcgaccagcgcactctcgagacagacaaggtctggctcgcctcgatccatctcaccgggactgcccaacattggtactacatgctggagcgtgacgagggctccatcccatggtagcgcttaaaggatctctgcctacaacgctttggtccccctctgcacagcaacttcttggatgaggctgcgcgtctctaatttcgttccacagttgaagactatcaagaccatttcttggctctcatctgccacgccgatccgccaccagcatcgtgccagcaggcgcaactcttcaccttcggcctaccaggacgcctccgcgtcgatgtcgagttgtgcagccatgcggacttgcagtaggccatggtcttcgcccagtcatacaaacgccactagcaaggttcggccgcccgcccacccgcctcagccctctgcgcgtctaccggttgcgcaattccctatgctggcaacgtcgtccgggtcaacggcggcggcctcagccccgacagcactgacgttcaagtgcctcaccctagcagagatggcggatcgatgccgccaggatctgtgctacaactgcgacaagccgtttgtgcgaggccatcactgccaacgtcacttctaccttgaggtgaccgctgacgacgacggggtggctgctgcggaaggtccccaacccccgtaatcctgccttccaggtcgaggacgagctgtttttggaggccggtagagctgttatgaccagcagccctaataaaagcaactagtttgtttggatggataaatatcaatttgttagtctgatatagagtttagatggataaggttggtcggctgagatagagtttagatgtataaacattggtttgttagatcttagataaggttggttagctaaggctgctatctcagctatataaatgtaccccttcaattaataaaagatcaagcaggaaagtatcttgcccgtgcttcccctacgtttctactgttcatcacgggcattgttcatccccattactgtcatctgcgtgaacagccacgtttcccccaaccagcagcgctaaccctaggacgatggcgcccaagcgccgggtattggtcctcgaccttccacccaccacctgtactacttccgtaaccctacttctaacaatatgagtagccactgacgttttgtaaagagtatagaacttaagtacatacctcttaagtgtttttatgaatcaaaacttcagtaatggaaacatcttgggattttattactttatttacatcattttcatgcaactaatctaaatattcataaagatattagtcaaaagtcaatttgtttcactgcaagtttcctaaggtaatactacctccgttcacaaatatatgacaccattgacttttttcgaaaattttgaccgctcgtcttatttaaaatatttattcaaaaatgtaaaattttaagttaagcacaaactaccttaagtgataaaacaaatcacaaaaaataaaaaataactcattattttttttgaataagacgagtggtcaattttttttgtaaaaagtcaacggtgtcatatatttatgaacggagggagtacttttctgaggctaaaaaatgttgtttcaagtggaagtttttagactaattatttgggaatacatggctatgttgcccttaggattgcagctgctgtctatgttctgtcctcttatgattcactgttcacatgatgtaccatgcattatatgattgcctcagacagcatcattgcatatgtgaatctagtagtaatataatcgcaagtttgtaacctgtaaattttggtatttcatttaagggttattgttatctgtgtttacttgctcactattagttgtatagcttcatatatccttgacatagctgttgtaatttgtgaccccgtgaaaaagctactgacaatttatcatttattcttgagatagggaaatgaaatgggggttaaagagttggatagccttatgactttgattgctgagaagaagcggcaaatggaacaacaagaatcagagacaaatatgcaaatattgctagtcttcttacactgccttagaaagcaaaagctagaagagttgaatgaggtttgtccttcgtatttttatggttctgaatttctggttctttcacacaattctaacattttaatgtcaagcaaccttcatcaatcttgctaattaaattaaatgaaatgaaagttttacctattgcatttatgttgctctttcttattctgaagtctattgttgttaatcatattcacatcttctcaacagattcaaactgatctacaatacatcaaagaggatataagttctgtggagagacatagggcagaattatatcgcacaaaagaaaggtactccatgaagctgcgcatgcttttagatgagcctactgcgcaaaaaatgtggccctctcctatagacaaagctagctgtcgctttcttcccaactctcggacaccacttagtggatcatgtccaggaactttacagaataagaagcttgatttgaaagctcaagtaagccatcaaggatttcaaaggagagatgctctaacttcttctgatcctcctaactcccctatacaatcgggtaatgttattgctaggaagaggcgagttcaagcacaggtgtgtttctcactccatgcattactacatttcttaaggcacagtttcctcccacattacacccaaaaagtaggcctcttatgtgttgcatacatgttttgaacagtatacagtacacacatggccttttacttaacttcgtgttagataaaatggcaccgatcttatgccatttattttttaaatctaattctatgaggaactttgcagttcaatgagcttcaagaatactacctgcaaagacgtcgtactggagcacaggcacgcagacaagaagaaagagatatagttgcaatgaatagagaaggctatcatgcaggtcttcaggatttccagtctgtgctaacaacgttcactcgatacaggtgtgtggttatctcttgtgtcgaggtaatatgcttttgtctttgttccattctcactagtctcaccttgtttgttgtcatgtttacttcagtcgtctacgtgtcattgcggaactaagacatggagacttgtttcactctgccaatattgtatccaggtgtgtagtttgcgagtttcttatctgtggtttcagaatgtaactagcagcagaaccagtgcagttacatggattgatatatttatgttttggtcatctgattttaaatatttatgcctacactataaattgtaaatcattatcgagcctttttgcagttctccaagagttactaccgattataattctggaggtaccaaaatcaagggctgtaaatgtttataattcgttcaccttttaatctgggcctaccttccaaaataagaagttaaatcttcacatcattactctggttaacgtgggagaatcagctccattaaagcaaacatggaagctgccttttggtgtaatgtaaacattaagttttattatacaatatatgaagtagactttcctgctctcctatgggaggatgcatgattcagcacatttatttccagttctgtgtgctagccaatcaactacttcacctttgttttattgcaaatatttggtatgggcatttgatgtttttgttatattgcagtattgaatttgatcgtgatgatgaactatttgctaccgctggagtctcgaaacgtattaaagtcttcgaattttccactgtaagtttgcttttgtcaggacatgtccatttcatagttcattgtaattgagaatagtaaggttgatttgcatcattacttaggttgttaatgaaccatcagatgtgcattgcccagttgttgaaatggctaccagatctaaacttagctgcctaagctggaacaagtactcaaaaaatattattgcaagcagtgactatgagggtatagtaactgtgtgggatgttcagacccgtcaggtatccactctctattcgacagttcattctgcaatggctgtattgtaattcaaactgaggcatatggtttctgtgtattgtgccatgctagagtgtgatggaatatgaagagcatgagaagagagcatggagtgttgatttttctcgcacagactcttcaatgctagtatctgggagtgatgattgcaaggtatttggaagttaatattgtaaaattacattctcattccgaaactaagagagaaaagcttggtgattttctcaaatgtcaagtaccaaaatcactttatgttatattatgacctgggtgggtggagcattcattttatcagacaactcattgaagaaatgatagtagttttagatggtcacaatgaatattaagttcatgaacacaacaacagatttttggtgtatgcattttcaagtaaggacaaaaaagaagaaataattacggctgttgtttatggcaggtgaaagtgtggtgcacaaatcaagaagcaagtgtgatcaatattgatatgaaagcaaatatttgctcggttaaatataatcctggatcaagcttctacgttgcagtatgttgcttcatgtctagcttatattgaatacttaatttgtttgcttttccaaccgaaatgttatttgtttacctatcaaatactacaatatttcaggtcggatctgctgatcaccatattcattactttgatttacgtaatccaagttcgcctgtccatatttttggggggcacaagaaagcagtatcatatgtgaaattcttatctaacaatgagcttgcgtctgcatcaacagatagcacattacgcttatgggatgtcaaggataactgcccggtatgctctttctgtgatagtgtgtgtatatatatatatatatatatatatatatatatatataatatatataatatataatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatatgccattcttcctctggagcttttgttgcaaaggaaagtggagttattttcgtttagaaagtactccaaactatgcagataaaagtgcttttgtttctgttatgttcctgtgttttctccagaataagcagttcactgctgtacataggactttttctttctgtaaaattgataaacaactgaatagaatatgaacttcagcacttcacatataattctcttttatactgcaccattttcttatagtgcaactggcaatgaattatctgatttggttcaacattacatgcccaatttgaaatagtgcagctacgaacataatttttggatgaccattttgttataacaacattgtgttttttcaggtacggacattcagaggacacaaaaatgaaaagaactttgttggcttgtctgtgaacaatgaatatattgcttgtggaagtgagacaaatgaggtttttgtttatcacaaggtaatggcaagcttctgtcctggtcatgttcccatgcagcatgcattgttatgatgtgtgactcaatataatcaatcagatgggttcctaactctacactgattgcaggctatctcgaaaccggcagcaagccatagatttgtatcttctgacctggatgatgccgatgatgatcctggttcttatttcattagtgctgtctgctggaagagtgatagccctacgatgttaactgctaacagtcaggggaccataaaagttcttgtacttgctccttgatgttatggagggcgttcaagaggttcacagtactgtccagttgtttcctttcgtgtcattatattcccccaaaattgggaacgggggcataattgatctccggttagggaatgaagttttgcagatggtcagctgacgtagggttttgaggtatcagaatgtgcatagtcatgtttatgttgtataggtgtaattgtgtaaagcagccaagttattggttacaagtgtaacacgagaaatacacattaataaaaaaaaaacctccagctcgtttgtacagagattgtgcttgaacccagaaccttatgtggtaattgcgattggtaatatatctacctgatatgatcaaacggatgccgtaatcagcaattgtttctttcaggtgtgtttttttcctgctgtttatggggtaattttcaagaattttttttaaaactttctggcgtgttgcttgaagaattatgttgtgtatatttaaaccaggcgatcttacaaagtggacgcacaccatatattgcaattctctacctgtatgcagacgtagtattttatctgtatgtgcccaggttctttctgctactagacgcctagagtggtacagtactaaagaaaactaggatcgtgctctttttcttacgaaacaatagtagggtcagcgcgtattagctaaaactagatcggttccacagaagaaatctaataaaaaggtaccaaccacttcctgagatagttttgcctttgcacctcacgtcacaggtcggagtcggactggcgcatctcagtcaccagctgcacgggggggacagtgaatgcgccggctgccgcatcgcagcttttgttcgggctgccgagtcgcattccgtccggtccggtgagcaagaggctcgttggcccttggagcgcccaacggcctatacggtttccgcaggcgcagccgatcgagcgagcgtcgcattgcagcgcgttacccgtgcacgcacagcacagatgcactgcacggcctgtcgaccgcgcctgcccacccatgccgcgtccccgatgcggcggaaggcgggcgagttgcgacggggccgtgccgctaccgcccgcggacgaaggaggcagcgtgagacatgccgacgtgagcgccttacgtttgtttattcgtccgcgcaccgggatagaggccacttgtcgggtgtcggctagtcgacttcacgggatgtacctcgcgatcagagtcgtccatgttatgaactgtaaactgctgatcgagtgatccacgttcaaatccaag

SEQ ID NO: 650 - protein, 693 aa, Zea mays
MGDSSVAGALVPSVPKPEPAPSGDTSAAAAATTAALAMPEEAGMRAASASPQGPAEEGEGPADRDLLCPICMAVIKDAFLTACGHSFCYMCIVTHLSNKSDCPCCGHYLTKAQLYPNFLLDKVLKKISAQQIAKTASPIDQFRCALQQGNEMGVKELDSLMTLIAEKKRQMEQQESETNMQILLVFLHCLRKQKLEELNEIQTDLQYIKEDISSVERHRAELYRTKERYSMKLRMLLDEPTAQKMWPSSIDKASCRFLPNSRTPLSGSCPGTLQNKKLDLKAQVSHQGFQRRDALTSSDPPNSPIQSGNVIARKRRVQAQFNELQEYYLQRRRTGAQARRQEERDIVAMNREGYHAGLQDFQSVLTTFTRYSRLRVIAELRHGDLFHSANIVSSIEFDRDDELFATAGVSKRIKVFEFSTVVNEPSDVHCPVVEMATRSKLSCLSWNKYSKNIIASSDYEGIVTVWDVQTRQSVMEYEEHEKRAWSVDFSRTDSSMLVSGSDDCKVKVWCTNQEASVINIDMKANICSVKYNPGSSFYVAVGSADHHIHYFDLRNPSSPVHIFGGHKKAVSYVKFLSNNELASASTDSTLRLWDVKDNCPVRTFRGHKNEKNFVGLSVNNEYIACGSETNEVFVYHKAISKPAASHRFVSSDPDDADDDPGSYFISAVCWKSDSPTMLTANSQGTIKVLVLAP

SEQ ID NO: 651 - DNA, 8127 bp, Zea mays
aaactgatttatgaaaataagtttggtggagatgtttgaaactcaatttctaagaaatcggtttctagttttttctatacacaattatcaacatatcttttctctatttttataagtggtgtcaatagatgtaaattctatgaaatcaatgagagcgtgatgcaattaaacaaacacaagctagttttagttagaggagagtagcttcttggtttttaagaacttgagaatttattttctataaatcagtttttttaaaattatgtgcttccaaacaacaccataaatataaatagaaatcatagcaacgtactagcaataagtagaaactatagtaacctacaaacactttactatttaacttatagcaaatgtaaatggatttatacacgggaacggaggagtacccgacgcaagactggtcattggatctttaaaaaaaagaagaataaataaagaaaaaggaagcacaatccccgtcttcagcggttagctacaagcctacaaaggcgaaagtatccgcatccacttcaggccccagcgcgagcgcaatccattccagacctgaacccctgccgagccccgatcccctagtaccatccccatcacagccatcgtcatcggcgcatcgcctcgcgcgcaatatccttggctccacgccccccactttacatccccacttctttattggaacaattggatctataccattaaaagatccaaactttagatatataccatggaccccacgtgttattaactcatgtggacccacatgtaagtgagatagtaatggtatagatctaaattggtgatcttttaatggtatggatccaaatttttcttctttattttatcctcgtgaatcaatgagcgcagcgaggaacggtgaagcaaagctaaggtatcggacgaacacatagggggcgagcgagccgactgacgagcacaagaccggcggacggggccgcctaatccagtgagagctcccccaagcgccatggcgtcggacagtcgcccccccaagcgctccccctccgcgcgacgcgtggcgccgcgtcacgcgcaccaccaccactcgcagtcgtcgggcgggagcacgtcccgcgcaggcgcgggaggaggtggcgggggcgctgcggccacggagtcggtctccaaggccgtcgctcagtacaacctagacgcgcggctccacgcggtgttcgagcagtcgggcgcgtcgggccgcagcttcgactactcccagtcgctgcgcgcgccgcccacgccgtcctccgagcagcagatcgccgcctacctctcacgcatccagcgcggcggccacatccagcccttgggctgcacgctcgccgtcgccgacgactcctccttccgcctcctcgccttctctgagaacgccgccgacctgctcgacctgtcgccgcaccactccgttccctcgctcgactccgtggcgctgccccctgtttcccttggtgccgacgcacgcctctacttctccccctcgtccgcggtcctgctggagcgcgccttcgccgcgcgcgagatatcgctgctcaacccgctatggatccactccagggcctcctccaagccgttctacgccatcctccaccgcatcgacgtcggcgtcgtcatcgacctcgagcccgcacgcaccgaggaccccgctctctccatcgccggcgcagtccagtcccagaaactcgcggtccgcgccatctcccgcctccaggcgctacccggcggggacgtcaagctcctatgcgacacagtcgtggagcatgttcgcgagctcactggttacgaccgtgtcatggtgtacaagttccatgaagacgagcacggggaagttgtcgcagagagccggcgcgataaccttgagccttacctcggattgcattatcccgccacagatatcccccaggcgtcgcggttcctgttccagcagaaccgcgtgcgaatgatcgcagactgccatgccatcccggtgagagtcatacaagatcctgggctgtcgcagcagctgtgtttggtaggctccacgctacgcgctccgcacgggtgccatgcacagtacatggcgaacatggggtcaattgcgtcgcttgttatggcagtcatcattagcagtggtggtgacgacgagcgaacaggtcggggtgccatctcctcatcaatgaagttgtgggggttagtggtgtgccaccatacatcaccacggtgtatcccttttccattgaggtatgcttgcgagtttctcatgcaggcatttgggctgcagctcaacatggagttgcagcttgcgcaccagctgtcagagaagcacattttgcgaactcagacgctattgtgtgacatgctactgcgagattcaccagctggcatcatcacgcagagccccagcgtcatggaccttgtgaagtgcgatggggctgcactgtattatcgtgggaagtactacccattgggtgtcactcccaccgagtctcagattaaggatattatcgagtggttgacggtgtgtcatggggactcaacagggctcagcacagatagccttgctgatgcaggctaccttggtgctgttgcattaggggatgctgtgtgtggaatggcggtggcttatataacaccaagtgattacttgttttggtttaggtcacacacagctaaagagatcaaatggggtggcgcaaaacatcaccctgaggataaggatgatggtcagaggatgcacccacggtcatcattcaaggcatttcttgaagtggttaaaagcagaagcctgtcctgggagaatgcagaaatggacgcaatacattccttgcagctcatattgcgtgactccttcagagatgctgcagagggcactagcaactcaaaagccattgtcaatggacaacgtcaacttggggagctagaattgcgggggataaatgagcttagctctgtagcaagagagatggttcgattgatagagacagcaacagtacccatatttgcagtagatactgatggatgcataaatgggtggaatgcaaagattgccgagttgacaggcctttcagttgaggaggcaatgggcaaatctctggtaaatgatcttatcttcaaggaatgtgatgatatagtcgaaaagctactctcgcgagctttaagaggtattccattttcatttcttatatggatgctattgcttttatattatgttttgtgagaagtgctgttgaggaaaatattatctgttcttggttgtatctcttaaggtatatgacataaacaaaaagtgtatggacacgatgtatacatgtttattacaccaagtattgaaatttgtggtatatatactcctggaaaatgtatatttgaaggagctgagcctaggtcagttggttgatagtgtggatgtacgcctagacccacatcccccaagttcaagtcattgtcgaggctaatttgtgcatgcatcttcttaatttaaaagccctcctatgtcagtcaagttttttttaaatagatatacccagtttcttagccacacttctttttgtgcacaattatatagaaaatggagacaaactagcaactaccgtcaaatttactcaatcattttcacagtgttttttagaaactggtgcttataattagcagataggaatgctcatgtgtgaaaagtaagcatatgagacttataccagaggttgtgttagctactcacaggagtacattgtttatcccccaggactattttgacctacttaccaatgcatgtagctaagctaagctagctttgatggatgttcaactggggagtgctaatttgtgaagttgcttcccatacaggtgaggaagacaaaaatgtggagataaagctgaagacatttgggtcagagcaatctaagggtgcaatatttgttattgtcaatgcttgttccagcagagattacacacaaaatattgttggtgtctgttttgttggacaagatgttacaggacaaaaggtggtcatggataaatttatcaacatacaaggggactacaaagctattgtacacaatcctaatcctctgctacccccaattttcgcatcagatgagaacacttcttgttcagaatggaacacagccatggaaaaacttacaggatggtctagagaggaagttgtcggtaagtttcttattggagaagtgtttggaaattgttgccgactcaagggcccagatgcattgacaaagttcatggttgtcattcacaatgctatagaaggacatgattctgagaagttccctttttcatttttcgacaagaatggaaagtatgtgcaggccttattgacggccaacacaaggagcaaaatggatggtaaatctattggagccttttgtttcttgcagattgcaagcgctgaaatacagcaggcatttgagattcagagacaacaagaaaagaagtgttatgcaaggatgaaagaattggcctatatttgccaggagataaagaatcctcttagtggcatccggtttaccaactctctattgcagatgactgatttaaatgatgaccagaggcagttccttgaaactagctctgcttgtgagaaacagatgtccaagattgttaaggatgccagtctcaaaagtattgaggatgggtcagcattctaagctttacccttatgctcgcccattctcgaatatttgcattgaatatttacatttgatcattcatattcgtttaacttgagcctggagtagccttaatctaaattttagttggtgctaatcttgactggtagatacagaattgaagtaggaattaaagttcatcagtcattagactgtcacagtttgttctactgtctttgcagttctttaaataaatatccccttgaacctaagttattgcctacattagacgaagatccttgttttctgtactaccctttaagacacttttgttattaccccttatggtacttgtgctcttgctcggacgatatttgaaactgtgtaagatcagcaacatttgccaacatatattttagttatatgttgcaaatatgaaggcagttcagatttctgtactttcaaagatgcattggtgttttagaagcttcagcttatcctactgtagtactgtgcttaaaagactcctatgggtttccatctttttattggaaacgaagtaccatattattgtactgtacagtgactggcgtgcgtctggctgattgtgtacatcattatggttgtaactgtctaatggttgacgatatggctactaaaccaggaccaagccaaaatttgatggttttcacagttcccagtggaatttggtgaatctggtgtctttttctctatttttttcaagtatagctaatagcgtggatattaaacaagtacatataataatgcctgcatatgctgaatcgttgaaattgtgtaaaaatgtcaacttctgtacaaacaaaaaacagtgcatagtgggtgttttctgcttaccaatgttagcatactgattactaccaggattgtgaacctttgtgcttcaaatgctatgtcatgattttttgttagaattaaaggaatatccctgtgaactgataaccttaccacattttaggaggatgtcaccaaagtttaagcagctttgtctaacatatctctgcctgtagttttgtttgaggagcttcataaattatttggagatgctgtatttcatttgcttgcaccgaaactcaaatcttttctggttgatttttatacacttgatcaggtccatctgtcttatctatcaataatgactgtgcatagattttaccccagaaaatggctaactttttttttgcaccacgggcgaactgaaaattacaaaagtgactaactttggcttgttcaacataatacttgattctcatctggtatagctacttacacaatcttatagtattactgtcactttatttgcttgacttaatttcatttaggttcattggttcagtgtttacactgtagataatagcatttttcacttctttgtaacctaagacataagtttgaatgttgctgtattttccacaattggtaattgaaaatttgttgatctgtttctctttatgtaacagctctttggtgcttgagaaaagtgagttttctcttggagacgttatgaatgctgttgtcagccaaacaatgtcattgttgagggagagggatttacaacttattcgagatatccctgatgaaatcaaggatgcatcagcatatggtgatcaatttagaatccaacaagttttggctgacttcttgctaagcatggcacagtctgctccatccgagaatggctgggtagaaatacaagtcagaccaaatgtaaaacagaattatgacggaacagatacagagcttttcatcttcaggttagcagcttgctctttttctattataatttgtctaaaatatttttttgtttcttcaaggaatatgtgttgttgaattttggtagaagacaagtaacatgaattacttcaacgttgagctggttgttcacatgtggtgtgatacctttcaaatatacgtccatgataattttgacagaattttcctgtttgcatcatgctgtatttttctttttcttgtgttgactcaatttctttaacttagcgtactggttgtgggatttgatggtaacataaatagtatgagagttgcttgggaattagatgattctggagaatcagcttccaaatgttaatgacaacggaaaactcaatgtaggggcttcccctacagtatttctcaaaaaagaaaaaaaacggaaactcaatgcctctattgggacttggcagtaccaattaagtgatttccttttgttttttttatatctgtaggtttgcctgccctggtgagggcctccccgctgacattgtccaggatatgttcagcaattcccaatggtcaacccaagaaggcgtaggactaagcacatgcaggaaaatcctcaaattgatgggcggcgaggtccaatacatcagggagtcagagcggagtttcttcctcatcgtccttgagctgccccaacctcgtctagcagctggtagagaaaatcagctgatatgttaagatctgcgctgacaccacctaacttctaggtcgattaggtaacttaggtggtgtttgtttgggattataatctgcctaaattatataatcagtgttagttcaaaataaggtagattatataatctggtcagattataatcccaaacaaatagacccttagctccctgataagagggtgcctaatttacaagaagcctggaaacaaatgaatgctgccatggcaattcaatggttgagtgttgatgaggaggctgtttttcggtgcgccgctgtaagtttgggtatccatgctgtggtttcaagatcagagttcatggcagatagttatgtacacaggcggcaaatttggttcttagcttaggttgatgaccagtttcacttagtacatcttatatgtatactaggtggatgcccgtgcgttgcaacgggaagataaaatatcacgataactcatgtacaaatatgttataatattatagaaaaaggttacaaatgtgttataatgtttaggaaagaaaacaaagtcacagcctgtgcattcactgggacctgataacattaggtggactaacctctccacatgacgaaaaggcaatagagttgcaattgcaagcacacaaaaaagtggtctgcacaagaaagtgtatatcatggcagatgttcttcggacttggaaaataatacacgagaaaaagaagacatggaaaatatgtagttctacacgcatattgttgatgcaccatcggtattgcacgaatcaacttgtcttacaatttctaataatagtcaaatatgtcgacaatcgtacattaatctaatctttttttgcgatactgataagtcgttgttgtatgtttggagggatagcatagcggcatgaattctcctcgtaacttaatagatcaattacaaagtttcttcgaagaatctttgtatcctacacacaaagacataagagaacagtacgtcaaatttatattatgtaactgaaatgtatgtt

SEQ ID NO: 652 - protein, 1166 aa, Zea mays
MASDSRPPKRSPSARRVAPRHAHHHHSQSSGGSTSRAGAGGGGGGAAATESVSKAVAQYNLDARLHAVFEQSGASGRSFDYSQSLRAPPTPSSEQQIAAYLSRIQRGGHIQPLGCTLAVADDSSFRLLAFSENAADLLDLSPHHSVPSLDSVALPPVSLGADARLYFSPSSAVLLERAFAAREISLLNPLWIHSRASSKPFYAILHRIDVGVVIDLEPARTEDPALSIAGAVQSQKLAVRAISRLQALPGGDVKLLCDTVVEHVRELTGYDRVMVYKFHEDEHGEVVAESRRDNLEPYLGLHYPATDIPQASRFLFQQNRVRMIADCHAIPVRVIQDPGLSQQLCLVGSTLRAPHGCHAQYMANMGSIASLVMAVIISSGGDDERTGRGAISSSMKLWGLVVCHHTSPRCIPFPLRYACEFLMQAFGLQLNMELQLAHQLSEKHILRTQTLLCDMLLRDSPAGIITQSPSVMDLVKCDGAALYYRGKYYPLGVTPTESQIKDIIEWLTVCHGDSTGLSTDSLADAGYLGAVALGDAVCGMAVAYITPSDYLFWFRSHTAKEIKWGGAKHHPEDKDDGQRMHPRSSFKAFLEVVKSRSLSWENAEMDAIHSLQLILRDSFRDAAEGTSNSKAIVNGQRQLGELELRGINELSSVAREMVRLIETATVPIFAVDTDGCINGWNAKIAELTGLSVEEAMGKSLVNDLIFKECDDIVEKLLSRALRGEEDKNVEIKLKTFGSEQSKGAIFVIVNACSSRDYTQNIVGVCFVGQDVTGQKVVMDKFINIQGDYKAIVHNPNPLLPPIFASDENTSCSEWNTAMEKLTGWSREEVVGKFLIGEVFGNCCRLKGPDALTKFMVVIHNAIEGHDSEKFPFSFFDKNGKYVQALLTANTRSKMDGKSIGAFCFLQIASAEIQQAFEIQRQQEKKCYARMKELAYICQEIKNPLSGIRFTNSLLQMTDLNDDQRQFLETSSACEKQMSKIVKDASLKSIEDGSLVLEKSEFSLGDVMNAVVSQTMSLLRERDLQLIRDIPDEIKDASAYGDQFRIQQVLADFLLSMAQSAPSENGWVEIQVRPNVKQNYDGTDTELFIFRFACPGEGLPADIVQDMFSNSQWSTQEGVGLSTCRKILKLMGGEVQYIRESERSFFLIVLELPQPRLAAGRENQLIC

SEQ ID NO: 653 - DNA, 13240 bp, Zea mays
aaccgggtgccaaaacctctccggctgccacgatgacatgtatttagggcgctagctctcctccgctagacacgtagcaccctgctacaccccccattgtacacctggatcctctccttacgcctataaaaggaaggaccagggccctcttacagagggttggccgcgcggggaagaggacgggacaggcgctcgcgtgaggccgctcgctccccctcccgcgtggacgcttgtaaccccctactgcaagcgcacccgacctgggcgcgggacaaacacgaaggccgcgggatttccatctctctctcgcttcggctgccttttcttccccccttcgcgctccatctcgcgccgacccatcttgactggggcacgcggcgacattttcactcgtcggcccagggacccccggtctcgaaacgccgacagtaagaaaatgagaatcccttaggatcagtttgactttgagaaccttattttcccaaaaaaatagtacattttttatttggaaaaaaacttttagaaaaatgaagttattaaactagcccttaataaatagatttgtcaaactagctaaagaaataaataagaatatactcctagttttcagcgcctaaataaaagctgcaaaggtaagagcatccgtatccacttcagctttcaagtttggagttcgtcgtcgtccccagcgtgactgcgcgagtgctatccattccaaacctgaaaccactgcggcccaacccggcaaccccgatccccacttccccagtaccatccctatcccagccacgccatcgtcatcgccttgcgcgcaatatccttggctccacgccccagtaagcgaccagtgacagtgagagcggtgaagcaaaccaaagcaaagctatcggaagaacctcagtcgagggggcgagcgagccgacgagacgactgacgagcgcacaagaccggacggggccgcctaatccagagagagccccaggtctcccccaaccccgccatggcgtcgggcagccgcgccacgcccacgcgctccccctcctccgcgcggcccgaggcgccgcgtcacgcgcaccaccaccaccactcccagtcgtcgggcgggagcacgtcccgcgcgggcgggggagccgcggccacggagtcggtctccaaggccgtcgcccagtacaccctagacgcgcgcctacacgcggtgttcgagcaatcgggcgcgtcgggccgcagcttcgactactcccaatcgctgcgcgcgccgcccacgccgtcctccgagcagcagatcgccgcctacctctcccgcatccagcgcggcggccacatccagcccttcggctgcacgctcgccgtcgccgacgactcctccttccgcctcctcgccttctccgagaactcccccgacctgctcgacctgtcgcctcaccactccgttccctcgctggactcctctgcgccgccccacgtttccctgggtgccgacgcgcgcctcctcttctccccctcgtccgcggtcctcctagagcgcgccttcgccgcgcgcgagatctcgctgctcaacccgatatggatccactccagggtctcctccaagccgttctacgccatcctccaccgcatcgacgtcggcgtcgtcatcgacctcgagcccgcccgcaccgaggaccccgctctctccatcgccggtgcagtccagtcccagaaactggcggtccgcgccatctcccgcctccaggcgctacccggcggggacgtcaagcttctctgcgacacagtcgtggagcatgttcgcgagctcacgggttatgaccgtgtcatggtgtacaggttccatgaagacgagcacggggaagttgtcgccgagagccggcgcgacaaccttgagccttacctcggattgcattatcccgccacagatatcccccaggcgtcgcgcttcctgttccggcagaaccgcgtgcgaatgattgccgattgccatgccaccccggtgagagttattcaagatcctgggctgtcgcagcctctgtgtttggtaggctccacgctacgcgctccacacgggtgtcatgcacagtacatggcgaacatggggtcaattgcgtcgcttgttatggcagtcatcattagcagtggcggtgacgatgagcaaacaggtcggggtggcatctcgtcggcaatgaagttgtgggggttagtggtgtgccaccatacatcaccacggtgtatcccttttccattgaggtatgcttgcgagtttctcatgcaggcatttgggttgcagctcaacatggagttgcagcttgcgcaccagctgtcagagaagcacattctgcgaactcagacgctattgtgtgacatgctactacgagattcaccaactggcatcgtcacgcagagccccagcatcatggaccttgtgaagtgcgacggggctgcactgtattatcatgggaaatactatccattgggtgtcactcccactgagtctcagattaaggatatcatcgagtggttgacggtgtttcatggggactcaacagggctcagcacagatagcctggctgatgcaggctaccttggtgctgctgcactaggggaggctgtgtgtggaatggcggtggcttatattacaccgagtgattacttgttttggtttcggtcacacacagctaaagagatcaaatggggtggcgcaaagcatcaccctgaggataaggatgatggtcagaggatgcacccacggtcgtcattcaaggcatttcttgaagtggttaaaagcagaagcctgccatgggagaatgcagaaatggacgcaatacattccttgcagctcatattgcgtgactccttcagggatgctgcagagggcaccaacaactcaaaagccattgtcaatggacaagttcagcttcgggagctagaattgcgggggataaatgagcttagttccgtagcaagagagatggttcggttgatagagacagcaacagtacccatatttgcagtagatactgatgggtgtataaatggttggaatgcaaagattgctgagttgacagggctttcagttgaggaggcaatgggcaaatctctggtaaatgatcttatcttcaaggaatctgaggcgacagttgaaaaactactctcacgagctttaagaggtatttccatttctgtttcttatatggatgctattgcctttatactacgtttcatgaaaactgcggagtgctgttgaggaaaatattatgttcttggttgtatctcttaaggtatatggcataacagaagcttatggacatgatgtacacatgtttattagaccaaatatggaaatgtgtggtaatatactcctggaaaatggatatttgaaggagctgagcctatctcagtttgttgacagtgtggatgtatgcctagacccagacccccaagttcaagtccttgtcgaggcgatttttttgcatatttcttctaattaaaaagcccttctatgttggtcaaggttttttaatagatatactcagtttcttaggcggacttctttttgtgcacaaatatatagaaaatgggggatcaactagagactaccaacaaattcattcaaccatttctagagtatttttagaacctggtgcttataactagcagacatgaatactcattagtcatatgtgaaaagtaagcatatgaaacttataaaaaaggtcatgttagttgttgaagtgtatgagtggattaactatcttttcccatcagcttaagcttttgggttcaactggttagcgcgtccactccaacatggtaccaaagacaaaggtctcgaattcgaattctggcaaaggctttatttatgcctccacccatttatttccacgtttgcgcccctctctctctctctctggctgcatttgcgcctttctctctggctacacgtaagtgggggtgttgaagtgtataagtggattgactaccttctcccatcagcttaagcttttgggttgaactgtttagtgcgttcactctaacattagctactcacaggagtacaatgtttctccccaggctgtttgaactattttaatgtacttcccaatgcatgtagctaagctatgttagctttaatggatgtgagattggagagtgctaatttgtgaagttgcttcccatacaggtgaggaagacaaaaatgtggagataaagttgaagacatttgggtcagagcaatctaagggaccaatatttgttgttgtcaatgcttgttctagtagagattacacacaaaatattgttggtgtctgttttgttggacaagatgtcacaggacaaaaggtggtcatggataaatttgttaacatacaaggggactacaaagctattgtacacaatcctaatcctctgataccaccaatttttgcatcagatgagaacacttcttgttcagaatggaatacagccatggaaaaacttacaggatggtcgagaggtgaagttgttggtaagtttcttattggagaggtgtttggaaattgttgtcgactcaagggcccagatgcattgacaaaattcatggttattattcacaacgctataggaggacaggattatgagaagttccctttttcattttttgacaagaatggaaagtatgtgcaggccttattgaccgccaatacaaggagcaaaatggatggtaaatccattggagccttttgtttcctgcagattgcaagcactgaaatacagcaagcctttgagattcagagacaacaagaaaagaagtgttacgcaaggatgaaagaattggcctatatttgccaggagataaagaatcctcttagtggcatccgatttaccaactctctgttgcagatgactgatttaaatgatgaccagaggcagttccttgaaactagctctgcttgtgagaaacagatgtccaagattgttaaggacgccagtctccaaagtatcgaggacgggtcagcattctgtttaccccttctactcacacattctctaatatttgcattgaatatttacatttgatcattcatatttgtttaacttgaacctgaagtagccttaatctaaattttgatggtcgctaatcttgactggtagaggtccaaaatcggagtaggaattagagaagttcatcagtcattagactaccacagttcattctactgtctttgcagttatttaaataaatttccccttgcacctaagttattgccaacattagatgaagatccttgtttttttgtactaccctttaagacatctttgttattatccctcatggcatttgtgtgtgtagaagggagagaattgttgtattgataggagatggggtacatatatatagggactcaaccctaaccctaatgggccggcagcccaacagtggtgccggcccacacacacagtctaacatccccacgtagtcgcaacggggacaccacacacgatgagactggagtagaggccgaaggtaggagccgacgggttgaaatccccccgcagtcgcaacgtcgtgatggtgcgaatgttgcggctggagtagagaccggtgtgtgctccaagaagacgatagcctctagatgccgaggtagccgaagtcgaggtggtcgcggtcgggagacacgcagcagaagcctgatcttcgggaggggtagacgttcgagcatcaacgatcggcagggcgacacaacaaaaggacaccggcaggccgacacaacaaaaggacaccggcaggccgaccttcctgcttctttgatcgtccgggcgtcaaggagccccgccagggaggccgacagcagcgcacgcgtctgcaccggtcatggtgtccgcgcccgcggcagaaaagaaggggaatgtcggatccggccgggaaggccacgacagcgacggatccggatgggaagacgcaatccagccaaagggatggcggatcgagccgagaaggccgcaacaacgtggatccggtcgggaaggccgcgaaagcgatagatccaacaagggcgatgaaggggtgggcagcgcggcgggtccagctgggcaggggcctgcgccggacctggcaaggggtgttgacgacggcgatgaaagaagctcgatgaatttgcgctgttgggtgtcggtgcgggcagttaggaggtcgccagcgcgatgaggaggggctgcacgggcgagggtgtcagcgggggacgcagcggagagggagccggcggtggtgggcagagggggggctgcgcgacggcgttggagtggtgctgggcaccggggcacgcaggaggggcgcgccatgggagcaaggagcacgccggcgcgcgcgcaggagggcggctgccacactggctggtggagggccaccggtggcggatctgggccgcggcttgtggacgcagccgcgacgctggttggcctgcaggcgcttgagcgaggccgcgagcgcgttggacagcgtcgggctggccgattgctgctggaggagccgcgccacgaaggaggttgcgggcgtacacggtgcaccagtcgctcaccgcggaggcggtcgcggcgctgcagctcttgttgggcctggcgcgccgcgtcggggccgccgtgccagggccgcccccggccggaggagccgcgccatggctgcgcccgagcccgcttggagacgcggcggcgccgacggccgcggacagggagcgacgagagatggtggccggctggaggttgaagacgaacaaggaggagtggagcttgggcgcttgctgtgattaccggtgaggtggagcagggagtgtcgggctccatggcaaggggctccgttcagccaccatgggaaggagtccgacttggaggtggtggccgaggagggtgttggagctcacatgtggttgtggagctgggaggccgcccccgggagggaaggtagggcctcccgggggcagcgatggcaggcggcggctgtgggggtgggagggagacgccggcggctgtgggaggtgggaggaaaaccctaaacctagtctgataccatgtagaagggagagaattgttgtattgataggagatgaggtacatatatatatagggactcaaccttaaccctaatgggccgacagcccaacgttggtgacggcccacacacacagtctaacagtgtggactacttctcttgctcagtcgatatctaaaactgtgtaagatcagcaacatttgccaacatatactgtagctttatgttgcaaatatgaaggcactccatattgttgtacttcaaaagatgcattggtgttttagaaggctcagcatattctactgtagcactgtgcttaaagactcctacgggtttggaaacctctttttatttgaaaggaagtaccataccatcataatgtacagtgactggcatgcgtctggcttattatatacatcgttatggttgtaattatctaatggttgataatatgtctactaaaccaggaccaagccagaatttgatggtttccacagttctgagtagaatttggtgtcttcgttttttcaaggatagcatgaatattacacaagtacattgaataactactatatatattgaataaattatgttaaaaaagccaacttctgtaagaaaaacactgcatagtgaggggttttctgcttaccaaatacagcatactgattactaccaggactgtgaacctttgtgctttaaatgctatatcattctaaagggaatagcctaagtccaagcagctttggctaacatgcctctgcctgtagttttctatgaggagcttcataaattatttggagatgctgtatttcatttgcttgcatgggaactcaaatcacttgtggttgatttttatacacttgatcaggtctatctgtcttatacactcgttgtatctttgatggagtggctcctagcctttccttcatcctagtgcagattgatgatgaaagaagatcatgggaattagctggagcgaggggtctctcctacttggcagcacctcttcttgaggccccccccctcctttgatctttagtgggtttgtttgagtgttgtctgtatggatccttttatttatgcgtgttttggcctccatagggaggtctttctgtaccccaggtcttctttagaccttctacttcttaatatattctaaagcgcagttctcctgcgcttccgagaaaaaaaaagtgtctaaaggcatgttcaacagaatagttgcttctcatttggctaagtctaaacacaaacttactaagccatcacttggaatagctacttacacaatcttattgtattactgtcacattatttgcttgacctaatttgatttaggctgagtgcttagacagtagcattttatcacttttttgtaacctaagacataagtttgaatgcttctgttatttccacaattgattaactgaaaatttcttgatttgtctctctttatgtaacagctctttggtgcttgagcaaagtgagttttctcttggagacgttatgaatgctgttgtcagccaagcaatgttattgttgagagagagggatttacaacttattcgggacatccctgatgaaatcaaggatgcgtcagcgtatggtgatcaatgtagaattcaacaagttttggctgacttcttgctaagcatggtgcggtctgctccatccgagaatggttgggtagaaatacaagtcagaccaaatgtaaaacagaattctgatggaacaaatacagaacttttcatattcaggttagctgctttgctcttttattataattcgtcacaaaatgtttttttgtttcttcaaggaatatgtgttgttgaattttggtagaagacaagtaatttgaattacttcaaccttaagctggctggccgcttatgtggtgtgatagctctcaaatatacgtctgagaattttgacagaattttcctgtttgcatcgtgctgtattttttgttttcttatgttaactcaatttctttaacttagtgtactttttggttgtgggatttgatggtaatatagacggtatcggaaggcaacagtgatggaaaatatagaaacgaacactgatattatttggttgagctgcgcattggatttatgctgcagcagtggagagacaccgccagttctttccatggaggtcacctccatccttgttgtcaagtcgtcagagggagaaagcaagcgcaaggatagtcacttgtggatgagaacggtggctcacatgtgacttcctcgctagctagctgacactacatgtcattaggaagatgcatgagagacgtgaggaagatgcctactacgcgttatgcaacttgcctttgctcgagagttgtgaggaagatgcagctgggtcgctgctacacgcaggtggttggtctttatagccgagggagatgccggggggggggggggggggggggggtgggtggtttggggggggggggggggggggggggggggggggggggggtggggcgggggggggttgggggggggttgtagcatccagtgatcagtgatgtagtccgtggagcggatgatgaaatcaacgccgtaaccagatactataacgctcgatcaggagttgtaatgaatttgtataggctgtgatctgattccatggtaagtgattgtgtcccatgccaaatcaaacacgtataacggtatcagttggttctgtaatcagctgtcggactaaaaactgtgaaccaaacaacatctaagttgtatagggtgccctagatcacatgtagtttgcactgaagtgaagaatgagaaaaaaatggctttgctgaggcatcaagcacggcaggcggcggcttgccgtcttcgtgctgcgacatgtggcttcccgacgcggcctcaagcacggcaagcggcgacgcgactgcaggctgtggtccgctgttccctggcacaacgacttgtatcgatattgcgcgttgaataacacgcgacacatggggcggcagggccttcagcagggttgaccgatcctccactccagttcactgtcctgatccatagccatgtggacagcaagaacacgtctagttgggtggcgctgtctgcactggaactcgcaacagctcaggttgtaggactggtgagctgccacgtcttggcctttgcatcctggacgaggttgttcccatgggatccaggggaccaaccttggcatatgttaggttttttatttgtttgcaaataaattaaagtcgaaatgtaaaaggcttctagttagggttgtctttcacgtgtagatcaagttagacagcaaggctgttgccatgcacccattacagctcgaggatgagttgtcttcgaatgtgggggaatgtcatagggcggcagcccagggcatatggaggcccatagggattggcttagagttaggattagtggataaagattagattatataagatttagttagttacttgagattggattagataagatttagttacttgggattagattagataagattgagttagttacttgggattagattagataagattaagttagttacctgggggctaagtcttcctatctatataaggatgggatgtaccctcttaagggggaatcaattaatgaagaagaattactcccatatctctctaatagtagtccccctcctaagctgactgactccgaccggctatctttccggcgatgtttatccccctatgaactaggatccataacaccatcccactaatatatatttttgattcctctcatatgatgtaccaagcactttttttgctacagaacaatgtttagattaacataggcaaatgcaaatctggatctatttgattagtacttttggatgtctattagataccaaaactgctgcctgccatagagcatcggtgccagataccaaaactgctgcctgccatagatcattggattaaatgcatttttgagggttgcaattaagtatgtctttaagtctcagagctgctgatgaggaaagaagaagatgggaagtagctggtgtaaaaggcctcgctcatttggctgcacccttggtagagacttaggaagatttgagtagtttgttttttgatccccttatggatctatatttgtatgcctgtttctggcctccgtaaggaggctcttctgtagacctttgtttttttctttcttctgcttaatatataatgggacgtagttttcctgcgcattcgagaaaataaaaagctgagaatcgacgaccttacctattgaagttcaaaactgtcctattaaatggtgccatggactgcaaatatgtaatcatctgttttttaagatgaattttactattttattgtcctggcttagcttgagcgaaagtgattgtcttttctgcaactcgtattatttcaacaacctacattcattacattgtgcattagatgattctgaagaatcagcttccaaatgttaatgacaatggaaaactcaatgcttctattgggaattgggagtaccaataagtgatttccttttgatatttgtatgtctataggtttgcctgccctggtgagggcctccctgctgacgtcgtccaggatatgttcagcaattcccaatggtcaacacaagaaggcgtaggactaagcacatgcaggaagatcctcaaattgatgggtggcgaggtccaatacatcagagagtcagagcggagtttcttcctcatcgtcctcgagcagccccaacctcgtccagcagctggtagagaaatcgtctgatatgttaagatccgtgctgaccccacctaactttctcggccgattacataacttagccccctgataagagggtgcctaatttacgagaagcctggaaacaaatcaaagctgccatggcaattcaatgactgaagtgttgttgatgaggctgttttcagtgcaccgctatccatggccatgctgtggtttcaagaccagagttggcggatagttacgtacacaggcggcaaatgtgtctcttagccgctgtttaagtgcaccgctgtaagtttgggtgtccatgtccatgctgtggtttcaagatcagagtccatggcggatagttatgtacacaagcgacaaacgtggttcttagcttaggttcatgaccagttccacgtagtacatatagcttatatgtatatatacaatctattttttactatgcataaggagttgtttcagcttacacggttgtatgttatagtcctttctaggtctactacatcctaatctagatctggttcctctggaatgttggcaccaccgctctgtattttgcggcgaaggtttgagtttggcctacctcggtttatttcattctcagaccttaatgtaaaagctttgacagttgacactgggtgtgtcctttgtagagaaagaaaaccttttcttttaaaaatcgtgttctatgtgttgtggaaccggtatgctgtttgaatatctgataagactgtccaacagtctacatatatgattatataaaacactattttcactatagactgcattgttcgtagaatagaatttaaatattagtataagaatagataaattgctgcagataacctaaagcacataaagcactagtttctctattttccactatcgtcacttttagaaaaaaaactttaatatttttttttctaatctaattgaaccgttacctcttagataggtcttgaaaaaaaatacccaaacctaagacgactcgaagctaaaagcagtgcaatgctctaggatagtatcatctcggtagatgagagaggatgggcgaccgagctagctataaaaaggggcatgctttatttttaactcatacctttctcggcattttaactatgtgtcacgaccaagtttcacacatgtaatgacccagtgtatagaaacaagtgtcacaaactctatcataaaaatataatgtctttacaaaaattaactaaacattaattcctccttcccaaaatatagttctttatagcccactttttacgttcatatttattcaaatgataataaatatagacatacatgtaaactacattcatatgttatttaatgaatatataattagcctaaaataaattatattttgggatgaagggagtataaactaaacaacgatcactatgatgatgacgacgacgatgatcacaagccacgagcagattgatcggagcgatgacagc

SEQ ID NO: 654 - protein, 1161 aa, Zea mays
MASGSRATPTRSPSSARPEAPRHAHHHHHSQSSGGSTSRAGGGAAATESVSKAVAQYTLDARLHAVFEQSGASGRSFDYSQSLRAPPTPSSEQQIAAYLSRIQRGGHIQPFGCTLAVADDSSFRLLAFSENSPDLLDLSPHHSVPSLDSSAPPHVSLGADARLLFSPSSAVLLERAFAAREISLLNPIWIHSRVSSKPFYAILHRIDVGVVIDLEPARTEDPALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVFHGDSTGLSTDSLADAGYLGAAALGEAVCGMAVAYITPSDYLFWFRSHTAKEIKWGGAKHHPEDKDDGQRMHPRSSFKAFLEVVKSRSLPWENAEMDAIHSLQLILRDSFRDAAEGTNNSKAIVNGQVQLRELELRGINELSSVAREMVRLIETATVPIFAVDTDGCINGWNAKIAELTGLSVEEAMGKSLVNDLIFKESEATVEKLLSRALRGEEDKNVEIKLKTFGSEQSKGPIFVVVNACSSRDYTQNIVGVCFVGQDVTGQKVVMDKFVNIQGDYKAIVHNPNPLIPPIFASDENTSCSEWNTAMEKLTGWSRGEVVGKFLIGEVFGNCCRLKGPDALTKFMVIIHNAIGGQDYEKFPFSFFDKNGKYVQALLTANTRSKMDGKSIGAFCFLQIASTEIQQAFEIQRQQEKKCYARMKELAYICQEIKNPLSGIRFTNSLLQMTDLNDDQRQFLETSSACEKQMSKIVKDASLQSIEDGSLVLEQSEFSLGDVMNAVVSQAMLLLRERDLQLIRDIPDEIKDASAYGDQCRIQQVLADFLLSMVRSAPSENGWVEIQVRPNVKQNSDGTNTELFIFRFACPGEGLPADVVQDMFSNSQWSTQEGVGLSTCRKILKLMGGEVQYIRESERSFFLIVLEQPQPRPAAGREIV

SEQ ID NO: 655 - DNA, 4445 bp, Zea mays
gctatctcttttacatgtttccataccggaaaaaaaagttaggaaaaagaacatgtttccataacggcaaaaaaataggtcccaccgggattcgaacccaggtcgccagattcaaagtctggagtgctaaccactacactatggaacccgtttatgtcataatgtggacaattaattattaaaccccagcatatggaaccaaatccatttcccactacctcgaaagtcgaaaccatttggtctagtcagaacaccgaagtatccaacgaatccattgtaattttgttgcacccgaaatggcgccgctacggaataagcggcctttatgcttggcgcgagagttcttccttcaaaatcgatcttcaacgttcaaattcaaaatgctacccccgtccattgtaaattgtatgtgttcagtattttatatataatgtttatgtttacagaaaaattaaaacgatatataatctggaatggagagagtagcaacatccaatccaatccatcgacccgaccgagagaaacgggagggcacgctgctatcagctacctgctccatagtgtcgcaaactcacagtcacagcagtcatcacatgcctcaaggctggaagggcagaacacttttttcttgacgcgtgtatctcagcgaccggcgccatcagtttgttttcgttccacgcccccacgcccaatgcgcccccaccgtccaggtccagccgtacacgtgcgtccggccggggatcgcagcagccgcacgcactggctgctgggctcggacggcgctgcccctgccgcagcgcagccatagattggaattgcggcgacgtggcctcctggcagcccaccctgaacaggcgcaccctatcctccgcctcgccgctcgccaatggacacctccactagtccacttggcgccactccagcttcacgctgcccgcgtctgtgattcccattcataagagctggccacgcagcctcggagcaacagacccccgcccacgaccacacgcagcaagcagcagccgcgcgctcgcctaggactaccgactacgagtagtgctcagctagcctccatcctcagcgcgcgagtggctgctgcgcattcctctctttatccgtctctgtgcttgtttaatttgtgttcgttcgtgagtaggcggccggcacatatggcagcgcagtccatgctcatgtcgaccagcgtcaacggcggccgcgcgctgccgtctcttcaggccgtccggccggctccatacccgcggctaccgctgccgtcgtcgtcgtcctcgtcagctggctacaggcactccaagtccgtctccgtgaagacgctcgccctgttcggcaaatccaaggtcaagaccgcgccggcgaagaaggtccgtgacccgtgcatggctagctagctagctagctgcacgtacactactgtactgctgctgtgccgtgtgttatgtgcacgcatgcatgctcctggctagttttattctattccctgtcatgtgttgctatgtgtgtgtatatatatgatggttttgctgtacaggctgctgcgcccaagcccaagccgaaggttgaggatggtatcttcggcacgtccggcgggatcggtttcaccaaggagaacgagctgttcgtcggccgcgttgccatgcttggctttgccgtgagtatagtcaaaagcactgcatctgcatatggagtgtgttcatgcacaccggaaggaattactccgtccctccgaaattataagtcgttgacgacacggccttcaaaatacaattttaaccatttaaaaattaaaataaactcttaatatttatgtttttttaaatactttcttaaataaattggtgtataacacgtgactattagtttttaaaactaaataataaaacggttatttatagtcaaagttttataagcttgatttaattcttatccaaaagatttataatttagacttggaggggtagaaggaagttgttcttatatatactctctgcgtttacatatatatgacgtttagaataagttagttagctttttatctaactagttttgttttaaacattatattacaaattaaaaatggagatagtgtaacagatgcaatatctttcgtattgaccaatataattagaggagtacacaccatcgatatctggtaatatattaggatatatatttatcttagcaaaaaaaaacatagccattcatttttgtgatagctgacgccgccgtagcatgatatggatatggacatacatatggtagtcgcagttacctgtgattttgtaaagttagcagcttcatgggttaaattcagcagggtaggaaaaaaagaggagtggtgggtggaagaaaattccaaacggtcaaaataattaacataaactactcacttaatttgaacctaaaataaattactcaattacacctctgctgctagcactctcccaaaataaataaattatagattgtctaatccacgcattattttgttatgcaaatctgctcgtgtatgtattattgtttcaaaccaaaaacggtagctagcattgccagttcaagctagcgaggatttattgacactgcttggcttcaggcatcgctacttggagaggccattaccgggaagggcatccttgcgcagctgaacctggagacgggcatccccatctacgaggcggagcccctcctcctgttcttcatcctcttcaccctccttggcgccatcggcgctctcggagaccgcggccgcttcgtcgacgaggaggtcaccggcctcgacaaggccgtcatccaacccggcaagggcttccgcggcgccctcggcctcagcgagggaggtaattaaaaaaagaaaaagaagctcacgacacctccgcatgcagctgatgagctgtggttgattgcttgatttgagtattttttatataataatgatggtgcctgcggtgcatgaacaatgcagggccgctgttcgggttcaccaagtcgaacgagctgttcgtggggcggatggcgcagctgggcgtggccttctccatcatcggcgagatcatcacggggaagggcgcgctggcgcagctcaacatcgagacgggggtgcccatcaacgagatagagccgctcgtcatcttcaacgtcctcttcttcttcatcgccgccatcaaccccggcaatggcaggttcatcatcggcgaggaagaggaataggctgctggctgctgctgctggcctcggacatgagtcgtgtgcgtttacttttacctgtgactgtgcgtctcggtgcgcgcgcgtaagtgctttgctgtgtatcaattactcgtgatgagacctcgaaggtagggtgtcgcgttgggttgtctgcttgtagaaacaagagcttatatataaattactactagctaatatgccatggttgcaacgagttctcctagactatataatcttgttgagttcgagagaccgtataaatcacactgattgaccttcggtactgagctgcatttctaagtggcgctctcttgtgtaactctactccgtttccgttctaacttttgcccccggcaaggtgattctgggagtaacgaccaagtttcagatatgatgaatgagcctatccgcttgtgtgtctatgggctggtaggccgagagtgtgatttgagcccaaatcaatggagtcacacagacgggccggccttgggcctgatgtctgatccttagccgcctaattagtaattcctgaagtacactccaactctcgaagtattacggctacacgtaaaccactgaaacggcggatttactgtgctgtgccagccatcgatcggcacgacacaggcacacagatcgttggttacctgcatggcacggcacatagctacgtaatagctggttcggtgactagggatttaaagatgatcaatggagaaggaaaccacatgctttcaagaaaggggtttcttccctgtggatttaaagactagggatttaaagatgatcaatggagaaggaaaccatttccttattggcaagacgacgccagtacgccacatctacgaaacggataataagcaccaaacggtctcatccactgtccccacgcgcagtagaaattgaagacaacctagacaagattatcaagggctaataactatagctattttatataaaaacatgtatatttaaacttaagatgcactttaaaacggacaaggcagcctggcctgcactgggtgctgagtccgcccctgcccacgcgtcagtgagctcttgcaaatcatggactcctatgagaaataactagccttccgaacccagctatagtacagctcagagtgggctctgtagagtctatactgttgggtgtgtcctctacagccggtcaatagagactggattgggcttaacccaactatcgttcctttaatcgggcc

SEQ ID NO: 656 - protein, 272 aa, Zea mays
MAAQSMLMSTSVNGGRALPSLQAVRPAPYPRLPLPSSSSSSAGYRHSKSVSVKTLALFGKSKVKTAPAKKAAAPKPKPKVEDGIFGTSGGIGFTKENELFVGRVAMLGFAASLLGEAITGKGILAQLNLETGIPIYEAEPLLLFFILFTLLGAIGALGDRGRFVDEEVTGLDKAVIQPGKGFRGALGLSEGGPLFGFTKSNELFVGRMAQLGVAFSIIGEIITGKGALAQLNIETGVPINEIEPLVIFNVLFFFIAAINPGNGRFIIGEEEE

SEQ ID NO: 657 - DNA, 2850 bp, Zea mays
gatacaaatacggatagctatgtgtcaaatacggaactagtcggacacggatattgtcggtaacgaattttttgtcggatatcatgtaagacatcattccacacgtatcatggttgtaatcatgtatccactcattgagtctaaacatttttgtattatatgtgttcatatgtcaccttttttttgtaaaattcatgaatttttagcctatgtgcgtgttattaatttattttgcataaaatcatcaaaatgcaaataagataccaaaactaataaacattctataagaatataacctgtctccacatgaaaatgataaaaaaaacttggatacttagagtgatttcacgtgtaattcacacaacaagtgaaagtgaaatgtaagaaacactatcatattttggattttatggtccaaatattttggaggattatatatgaacatatggtatgcctccataaattttcataattttctgaggctatttgtgtattattaatttttttctacaaaaaatcaacaaaatgcacacagctatccggataagatatccggatatccgagaagatttatccgagaaaatatccggatattcgatatccgacggatatcagacatattgtattcgaattcgatatccgaacaaaatatccgtattcgtatccgttatccgaaaaaatgtccggatatccgaaaattccatccgaaccagtgttcaccatcttcgaatccggatccggacggatattttccgaaccatattacatcccctatataagcttataagggaaaaaagactcagtcagcatttgttttgtcctgctcgatcgtcctagtcacctccaactccagaagcctcgcagtcacctggcatggaagctccatagtttaaagggctccactctgcacgtgtcaccttcccgccacacgtgtccatgctcggagcaagcctcgcgcgtatttagaacgcgtcttgcgacgatccggcttcccctgcctgagagaatcggctcggacagtcggactcgatcatcaattaagcgaacctcgccgcgatcgtatcagccatggcgaccgccgcgcacgagggcgtgacccagcgcgtcgctgccagtggcagcagggacgacggcgccagcggcggcatcgcggcggtctcgggtcccaacaagaagccgggcggcggcaggaggcggcgcggcctccgttcggtcgccgccgcggtgtccatccccgcggcgctcgtggctctgtccttcttcgccgcgggccactccacgccgccgccgagttccgccacggtggcggtggtgcgggccgggtcggtggcgtcggaggcggtgctggcgctggcggcgtggatggcgtgggcagagggcgggctgcacgcgcgtccggccgccacgctgctgccctacgccgcgcggctcggcgccgcgctcgcgtgggcgccgctcgtgctgggccgccacgccgcggcgcgcgcgggcctcgcctgctgcgccgccatggccgtgggcgccgtggcgtgcgcgcgcggcttcggcgccgtcaaccctgtggctggcgacctcgccaagcccgccgtcgcctgggccgtcatcctcgccgtcgtcaactacaagatgctctgagctcccgagaacacgcgcgcgctgttcgtgttcgatcctcggcagccaggcccctggttatttgttgtgaacatgtaataatgcgttggtttgtgtacagtatacgttctgagtatgttgttgtgtcctgcatattcatctgagaatgcagccaggcccctcgtcaactacaagatgttcttaaatttcgattgcgatgtaacaatgtatgtgtataccgtgtatgttctactactatgacgacgtatgggattggggagagatggatggtggctgtcatgtgctgtcatacgtcagctgccgaaaataatagtcagctgccgaagagatggatggtgtcatgtgctacgacctacgcgttgggcggcgtgaggtgaggacggacgtggctataggagaggaattgattacgcactatggagcctggaagggttgaagttttaagaaggaagataattggaagcctctctctacatgaaaattatcatactaatgaactcatttgggtcggtagaaatgatcacatctttgatgggattctgccgaccatacttaaattgctgggttttctttaaaaaaatatttgctttggttatccatagagcgaagaaacaacattttcctcttatagaggagtcgctagagcactaattgtgatctctttattatcttcttttttgcatcctaaattctgttaaatttacttggaacacaacagccgaaatgccaataggcacatacgcgttgggtactcaaaatgatgacaaagcacaagcatcaacattgctattccaatagataatgttatacatattatccataaaacaaagacgaacttgtgtaggctcactgcaacaaaaaggaatgaaacgatactgaaccacgcatgagttcaccataaggtacgcaaagacaaaacacagtaatacttcttgatattggtttatgcagttcacattccatttcatcttctactgggaaggaatgggctgcatctctggtgctgcagcaacgtcagccacggggtacctgaacacgcgggcgagccgctcagtgggcaccagcgggagataggtggccacggcgttcccgcgcttggcaccatcacgcaccgccgaattgtacctggcagagagctgtgcggcagtggggaggacggccctggtgaccgagggcaccagagggagacggttcagggccacccaggcctcggcg

SEQ ID NO: 658 - protein, 188 aa, Zea mays
MATAAHEGVTQRVAASGSRDDGASGGIAAVSGPNKKPGGGRRRRGLRSVAAAVSIPAALVALSFFAAGHSTPPPSSATVAVVRAGSVASEAVLALAAWMAWAEGGLHARPAATLLPYAARLGAALAWAPLVLGRHAAARAGLACCAAMAVGAVACARGFGAVNPVAGDLAKPAVAWAVILAVVNYKML

SEQ ID NO: 659 - DNA, 4787 bp, Zea mays
agaagcatcttcataattgcactgaacaaagagccactgcagtaacaagcaaatttcaaaagggatgaatgaatcattaatacataagaagaatctgtaaggaaaataaagaagacaccgcatttacaagctacaatctcggagcttatatttgatgattcctctccctcgttgtgttcaattgagtccactaagcaaatctgcatcatgatgcttatcgctgtgacagtgtactttgcatcgcatggaacaagcaagtgttgaaaacaaatcacacagccaagcttacccaaatcatcaattgaaaccgcagcagtggccgagtcccactcatccatcgcatcctgagccgcctaaaacaggtatcccagaagaagggaaacgtaataatagaaaacaaatccaacaattaggccacaattccggcaaaccaaagtgaatcctcgccctcgcatgtgtcacagaatcgaccctgagtagcgacgaccttaccttgtgcgtggagtccaaacctagtgccacctcatcctccgccacctccgcctccggctccacctccagccttttcaatgagagctgctccacccggctgaaacgaacacgcaaacaaaacaaaaggggaacaatgcagattgaagaaccagatccacgggaaggaggaacccaccaagcagagacggaaaaggaggatcgctggctaacctatgaatggcggacgcatcgaggggcgcctcgtcgggaccttgcgccggtactagggcttgcgcctccgccatggccgtctcactctcccgcctagtagacagagagatttggttttcgaaacggaggggagaaggaaagcgagcacgtgactaacgtgagacagatgaacgactgcgattcgtccgggcatgcccgactcccttcagccggatgcctggactggatccgtttgcgcttaacggggccccgtttggtcggcccgtgataagcaggaggccaggagcagccgccagccagctagcagcgtccctgctgctccgcgccacacctctccgcttcattcctatccgtctcccctgctctatcgtcgtcctcctccgtcgggccggaggagcgtctctttgtcggcgcagcgtgcagagcaccgcaggttcggctctttggcttgctcatcccttcccctcctctcctaggttctccatcccgcgccaccttcttgttccagttgcgtctgcattcagggctacgtagcatcattagacgaaggtttcgtgcgcggttaatcatgcttggaagtgagaattttgtgacccggatcgatcttggcgcatattttggacctagtgattgcgaggatataaacgcgctagaattcagctgcggacacttcttgtcagatgtctggcggcagattggtagttcagtcttattaataaaataaaacaaaaaagagatgagtcatggctgcaatccataaacacaaactgagaatgtactctaatgtttatctagagaaagcctgaaactttttctgcgaacatttctgcttgaattggtttgagttctatactgaactttcctcatgagctgcagattcagagacacgatgatgtcgcgacagtgtgcaaaccgcatctttcttaccggaggttccagcttcctccatggcctcaaatctagagttgcatccagtaggagtcacggcaccgtcagactcaactggcgctgcgtgagaactaatctctggagggccgagcgccttggtgtcaaggctactccgtctgaggtaatacgattgcttattcgttgctactgaccaattcacctcttgttataccactaagaagtaagaacagcaagtttttgtctcctccagcatatcattgcagtactgcaagcgtcagatattttcagtggcatcaggaaatggagcaagttgcaattggtcgccatgacaggggtgatggcatgtgtagttctggtagtcccttcttctgatgcagtcgatgctctcaagacatgcacttgcctgctaaaggaatgcaggtgactcttcatcatactgtcaacatagttttgacaccatataggggctgcttggttcggaaatagtctcgcctggccaagcaagccttgccttgccaccgtagccgagtgtaattctctcgtagaaactagccaaaatcatgcctacagaccacaaaggtttgtgtgaatttatattcagtatgtagccaatataggtcaagaagaagttagttactacttgaaactaagagctccccgatgacaagtttgtcatcttttggatgagagtaaccttagatcattttatacatttcttactcaattagtttctctctctctctttcagaatagagctggctaaatgcatagcgaacccatcctgtgcagcaaacgtagcatgcttgaacacgtgcaacaatcgacctgatgaaactgaatgtcaggttattcccataaaccttgagctcactgaaatctgccagaaaaaataagttttttatgccctgcttttgtcatccatcagataaaatgcggagacctgtttgagaacagtgtagtcgatgaattcaatgattgtgctgtttcacgcaagaaatgtgttccaaaaaaatccgacgtcggcgagttccccgtccccgatccatcttcgctggttaagagcttcaacatggcagattttaatggcaaatggtacatttcaagtggcttaaacccgacgtttgacacattcgattgtcagcttcacgagtttcatgtcgagggagacaaattgatcgcgaacatcacatggagagtccgcaccccagactctggcttctttaccaggtcaaccgtgcagcgttttgtgcaggacccatcgcagcccggcatactctacaaccatgacaatgagttcctgcactatcaagatgactggtaaaccctcttagaaattctttctcactactgccaatgtgcccattcctcaaggtttatcgacttggtatttgctgacctgtaggtacattatctcatccaaggttgagaacaaggatgacgactacatatttgtgtactatcgtgggcgaaatgacgcatgggatggttatggtggttctgtattgtacacaagaagtaaaactgtacctgaaacaataataccggagctggaaagagctgcaaagagcgtaggtcgggacttctcgacgttcatcatgaccgacaacacctgtggtcctgagcctcctcttgtggagagaatcgagaaaactgtggtggaaggagagaagaccatcgtcagggaggtgaaggagatcgaggaggaggttgaggagctggagaaggaggaggcgtcactgtttcagaagctggcagaaggtctcatggaggtgaaacaggatttcatgaacttcttgcaggggctgagcaaggaggagatggagctgttggatcagctcaacatggaagcgactgaagttgagcaagtcttcagccgtgcactaccgttgaggaagctaaggtagctgcagagcaaaggacttggagaaaacaagccatcaagtactggccgaaacggattctatttgccacagcagtacccacagtagagattgttgaacagatacaacaaacatttttaattttcttttctttttcttttcttttcttttcttttctttgtttacccttttctgtggtcaaaacacatgcctacgttagccctatttgtaaagcatcaagagacaacgtaactttttcttgccaaacagagaaaaaaaacaagtgtacttaagactacgctgaccatctcttgcatgacaattgtttgttgttatagtttcctttgccattccatctaaatttaagtcatttccctatgtaaaatgcaaaatcaaaaggaactcttatatttgtacgccgtagtgcagtaggggacctctaccccagttttaaagtagaagtaaaaaacggtatagttacatatcaccgaatttcatggggttttttaaggagactatggaaaagttgattatactaaaaatcttcttcaggaagacaccaactagaaaaatgctagtaaaaggataactggttaacttgtatggattttactagctgtggtatgcagtattttttgtgtttataatcttatcatagcaattaaaaataacaaggaagcacactgtagcttatttctaaatactccttttgtcccaaactaaaatttattttagataattaatagtacatttatacaatattggatttatgtattttatatatgtgtctaaattccatttgaatatagataaaaaaacgagctaaaacgaatgctattttgggatggagggagtatattttattttcgaacgccccagttggtatgcatgtcatttcattaaaaagaaaaaaagaaacagggttgtccagctacggacggacaggatacactagacccacatgtgacctgaaaactagaaaaaaacagatttgatacaaagctctagacatgaccaacagaaatgctctaaaaacagtggaggaccatccagtcctggacagcgaccagacaacaaattattgcagttttgaagcccaaggccccaagcccaccaccacatcctgccccccacccctatctgtggaaaggagatcgggtatgcatggccttgctttttcaagaactgaaagcacattgttggtgtcttgctgatatccacattaactaactatggaattccagagcccattcgataaaccttttattgttgcaaagaaattgctcactccatact

SEQ ID NO: 660 - protein, 446 aa, Zea mays
MMSRQCANRIFLTGGSSFLHGLKSRVASSRSHGTVRLNWRCVRTNLWRAERLGVKATPSEHIIAVLQASDIFSGIRKWSKLQLVAMTGVMACVVLVVPSSDAVDALKTCTCLLKECRIELAKCIANPSCAANVACLNTCNNRPDETECQIKCGDLFENSVVDEFNDCAVSRKKCVPKKSDVGEFPVPDPSSLVKSFNMADFNGKWYISSGLNPTFDTFDCQLHEFHVEGDKLIANITWRVRTPDSGFFTRSTVQRFVQDPSQPGILYNHDNEFLHYQDDWYIISSKVENKDDDYIFVYYRGRNDAWDGYGGSVLYTRSKTVPETIIPELERAAKSVGRDFSTFIMTDNTCGPEPPLVERIEKTVVEGEKTIVREVKEIEEEVEELEKEEASLFQKLAEGLMEVKQDFMNFLQGLSKEEMELLDQLNMEATEVEQVFSRALPLRKLR

SEQ ID NO: 661 - DNA, 6547 bp, Zea mays
ctagagtgatgaagaatcaacatgcagggagtgcttgatccttgcgctgatcaagaggagccacacccttgcgcggttgctccaaaaaagactagtggaaagcgtcgactttctgatacctcagaaaaacatcgtcgtgttcctaacacttcatttactttgaatatttactattgtataattaacttcttatatttagattactagaattgtcaagttagaataaggttagaacttaaggtgctaagcttatatgtgaatggtagaaaatattattgggcacaatgtggcaagtgagctatttgatagaatttaattattgcgaaaaagtttatcgtttaatttatatttttctcttgagtatcttgatcggccagaaacatagcattgtaaagtatatttgaagctctccaatatggttaaaattgaaaaaaaaaattgcacaactaggcgtatccagtgagaaaaggccttgccactctacgtatctgatgttgttaataatttcagaagtcgtcgtatataccatggggtgtttaattgtcgtatatacgatgggatgcttaattgtcgtatatacgatggtatgatgaaacaactgacttaaacatcacactgaacaatttcagaaaacgatccatgccgtcgtatatatacgacaacaaaataccagaagcaaacctcccagacccaaggggaaataaacgggcctgcttctggtcgctagcttgggggcgctggagctgcagtgcgtaggcccgtccgatccgtggctcgtctcggcatggccacacaaaccacgaacggtcgtcgtgcaccgcagcgcggcccccccgttctatcttctccagctccaaatggcgccatcgcggcggccgggttatcttgtccagacgtgcatcatatcctccgtgtgatccattcatccccgcgccgtgctagcttgctagttgcaagcaccagccgaccaccaaacggtagcgcacgcggacaatttaacagcatcaggtttaggccctgctgccgtcgtcgagcgcccgggccaccgcacacctgaaagcaatggagatcgtcgccacgcgctccccggcttgctgcgccgccgtgtccttctcccagtcgtacaggcccaaggtacgtacggcaccttcatatctcgtgactactgtacgtaagcggaaagtagcagcagctcgtcgcgcacacgtgcagaagccttaagtttgctgatgatgttgatgactggcgccacacgtgcggcaggcgtccaggccgccgaccacgttctacggcgagtcggtgcgggtgaacacagcgcggccgctctcggcgaggaggcagtccaaggcggccagccgcgcggccctcagtgcccggtgcgagatcggagacagcctggtgcgtacgcgtacataacatcggccgtcgtcgaagaacgaagctgacgccgctgccgcgtgccggctccgggttgtggtgtggtgtggcaggaggagttcctgaccaaggcgacgccggacaagaacctcatcaggctgctcatctgcatgggggaggccatgaggacgatcgcgttcaaggtccggacggcgtcctgcggcggcacggcctgtgtcaattccttcggcgacgagcagctggccgtcgacatgctcgctaacaagctcctctttgaggtgtggtctcgcaccgtaccgtacgtctctctctcacacacacacaacacaacggtccttttcaattggctcgtgcctgctctgtgcctgcaggctttggagtactcacatgtgtgtaagtatgcgtgctccgaggaagtccccgagctccaggacatgggtggcccagtcgaaggtactgccatttcttctctaatctctaaagtaacaaagaaaagagaaaaatcccattcaacccctagatattaggtacatgtcatgcacccaataacaatgaatcatttccatttatctgcaatacactaggatagggagtaagggcatgtttcgaagtacccagtttttcataaactagtttatgaaaactaaagtggttccaaatataatagttcatgccctagtttataggaactggatttccagtttttgagatggttctaaacaccatcaaccaattttttagaaattaatttgtagaaattgtagatagaaactaaattcttaaaaactaggttgcttccaaacaaaacctaattcaattattgtacaaatactcaagttttactatgtcacattactactactttgaaacgacatgtaatgtaacacgtcacatttttttcagctcgcattacttttatgtcaggcattactgtaaaaacatattgtatgtgtatgtttcttttttctaatatatgttgccacgttacaataataacacatatcatgtcgagtttattgtatttgcattcaaagtgtaatgtgcatatgtctcgtttgcttttatttacgttgcatttgaaaaaaaaaacatacaagctatttttgtcgatattttattcaggtagctaatacgtccacgtacattgtttgaacaaattagtaggttacatcatattatcttttaaagcgtcacgcacacgtacactagagtatggctatgtttagaaccatagagctaatagttagctagataataaattattagtcacgttgagtaagctaattaattaattaattattagttgtgagttaactaacaattagttagggttttagtgaggatgtttaaaacctgtataactaattttatcagctaactaatagctctagaggttttaaacatggcctactctacactatattaattgtcaatttgtcatgttatatttatgctcacaaattatgtcaatgtccaaagttgcaaaataaaatgattgattcatcaaatctaatactctctctgtttcaaatatttcaaattataattcgtttgactttttattgcgtgtcttattaaaaaatcatagttattattattatttattgtgatatttttatcatatgatatactttaagtatgactttgaaattttaattattttgtaaaaaatcaaataagacgagccagtcaaatttggttaaaaaagtcaaacggattataaattaggatggaaaaagacacgcatgcattaagtagatctggaaaaagattttgatatataatactttacaattttgcaaaatagaaaatcaaatattatatattcggcctgttacctcaagtaatagatgatataaccatctgattataattaaataaacgatttagtgctttcagagtactgtaggtcctgtttgacactttttatttcacagcttgttcacatacttaaatagaagctatactaaacaggactttcctgtagtagtttatcagtttacttacttgttagaaggaattaaaagtagacaataaatagaagctgttttccaaccgcttcttagataagttgtttttcgataaacagcacctgcgccaaacaggacagcaaaaccttcctgtgcaggagtacaacgccaccccccccccccccccccccaccaaaaaaaaataaacaggaaaacggacattgtaattagagagttgcagggcttcagtgcagcgctactagtcggcagtatgccaacatatactccattgtgcatcttcagagcactgtagaaatgtaactgctaattaacagcagtatgcctgaccaaattagcatgctgccttcctgtagtctagttttagatgatttctgatcaccaaactgcaacacgtcaaatgtgccgatggctttccaagccttccaccttgccgaaacaggcacacgttcttttggaccgcggctctggatatgcagaaaaccaacacaacctatatacgaatgaaagcctccgcgatcgattccgatcggcctgatttccgtcacatctcgcaggtggtttcagcgttgcgttcgaccccctcgacggctccagcattgtcgacaccaacttcaccgtcggaaccatcttcggagtctggcccggcgacaagctgaccggagtgaccggcggcgaccaggtcgctgccgcgatgggcatctacggccctcgcacgacctacattgtcgccctcaaggactgccctgggacgcacgagttcctcctcctcgacgaaggtaaatggcagcatgtgaaggacaccacgaccattggggaagggaagatgttctctcctggtaatctgagggcgacattcgataaccctgagtacgacaaggtactccgttactggctcctgttactgtcagtatttttttttcttcttcttaatatctgctacggctttctgtgcgcgcctaatcggtgctacaaatatatgtatcttcagctcatcaactactacgtcaaggagaagtacacattgcgctacactggaggaatggttcccgatgtcaaccaggtacatacgtatatatcacaaaaactttaaataattcacacccttagggcttgttcggttagctctcaatccatatggattgagtgggattgggtgggattaaatcccaagcaagtcaaagttcttctaaattttttccaatcccattcaatccatgtataataggaataaccgaacaaacccttagtaaaccacacagaaaaatcccgacacctcacaacccgtacgttcactcgatcggatcactagcttaattagtaatcaggagtagtacatgttccaaaaccaaacagatccatatatgattaacctgtcatgtcaactctctacacaccttgcacaccaaaacagccaaattttcagagaggacgacggcgcaaacttttgagaagaaagaatttggtttgacgttgccagtaaaatgtctcgggctgtagagtcactgcaagcccatgctagtgaacattgagctctgtgtaccagcgtctgctttaaagcaaggccacgccaagcaacacagcaattccctacagtgaccccccaacctcgctttcgctttaggtcttttcctatgccgctttcagtacacagaacctgcgtgagcaccagcatatatgcatgcatatgatgcctgtgagtatggtcgatgatgacgcagatcatagtgaaggagaagggcatcttcaccaacgtgacgtccccgacggccaaggccaagctgcggctcctcttcgaggtggcgcccctgggcttcttgatggagaaggccggcgggtacagcagcgacggcaagcagtcggtgctggacagggtgatcaacgagctcgacgagcggacccaggtggcctatgggtccaagaacgagatcatccggttcgaggagaccctctacggctcgtccaggctcgccgccagcgccaccgccaccgcccgcgcccttatctgaattactagaatccgggctcgtagatgctggagtacacagtacagggaaattgcccacttttttcatcaacttaagtttttagattaaacttttttgaaacaatcagacaggagatctgtcttatatattgatgaggagaaagatgcccaaaggcaaaaaaaaaaaagtcgatacaataacaagtccatcagctgctagaacagcctcccaaccgcaaaccaaaaaacaacccacgactagcatcctatctaagttgaagccaaaaagtagtcaagtgcctcgcctggaccgccatccagactgtcgcctcacatttaatgaggttacaatctactggctactagaaaacatgcaatcaaaagtactcgtatttctttcctaatatattgtcccgttgacaaggatcagcaacattctaaagcctttttctattacagcccaacaacatagccaattctcccaccaatgcatcaacgtgggagataactcctagctggatggcttcataactccagggtacctacacatagagcacaagttagggtatggggccaatttctagaagctaaacggcccagtctaaatacaattttgaattgcttagctgaaaaacttgctctttggaacgcccaggtatgagtctgtgcaaatcgaggcgaaaaattacgccttatatgccgatttcactgtgtatcggtggtctgcaatgaatttctagctgaagatatctttggcctctggatctaaatggatcttttgaacttcgaaccaaaaaaattgaagaactcatgaaaacggtgagggtgtaattactttgaccaagcagagcgagatccacgatctagacattgtcttttaccgcctctaccaatgatttgctcttgtttcttgatatagtaaagagcctaagtgccacgtccttcagtctcagcccttctgccgaaactctgttccagaagagtactttagaaccatcagtacatcaccaatcctaatatccgtcgaaaccataaagagcagtctatcaataatagagcaaggtgtttccaaattgccccggacttttacatggcgaggtgcaataattctgccggttttagattaaacttgtggatacatgcaactcgaattatcgttatctatttttatttt

SEQ ID NO: 662 - protein, 385 aa, Zea mays
MEIVATRSPACCAAVSFSQSYRPKASRPPTTFYGESVRVNTARPLSARRQSKAASRAALSARCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLDRVINELDERTQVAYGSKNEIIRFEETLYGSSRLAASATATARALI

SEQ ID NO: 663 - DNA, 5087 bp, Zea mays
ggtgcagagggaggcgaacggacagtaacagtcgccatcagagctaccgttacagtcaatcagaaactaacgccattatagacgtccgttactagacgacaaccagtcattacagcccatccgttactggccataacacaggaaacaaccagtaacgtacttcgaaccaaggtccaatctaccacgaccacgtcccggctggtgtcgcgcgcgcgcgcgcatgtggcaggctttcatcatttttctcaacttctcaatagatgtgtcaatgatccacctatttaagttgatttgattgatttgttcctcgaacttatgatactaaagtattagtataccgtatatttaacgtgggccttagcattgaatattaatttgggcagacccacgttaatccaacagtaaatagactggaatctaatataaaaataaatttgaatttagattctattcccataaataaaaatggacccgaaagagacgcagaatctagagccatatagatgcaaagaagccaactcttttgcccccacggcatcggattcgcatcgtctcctttcctttccccgtcgctgccgagcgcccaaagcgcgaggtggcgtgtcccgtgcgccaattgccagctgaatcaggctcgcatctgcgttccaacgcagatggctgtgcagcgcagttgcaaatgggcctcgtcaacacaagtgcactccggcatcacagttcacaggctaacagcagcgaatgatccaaccgtgaatcctgttatttgcagccaggccaatgggcatttgccctgttttctcggacacgcacgcttactctcttgacccggcggcgtgccgtgccgtgccgacgcaccaagtcaggctcagcttcctgagcatttatcgccgtagatatccgcacccatgcggcacatacgtggaacccacaccccatcgcattccccatccaccgtcctccgcccagcaccaccaacgcgcgccccggcgcctatttcaagccacgtcccaacaacttgccaattcgcaccgcgggaccggcgccgtcttgttgctccgctccggccgtgacacgagcgcaccagccaccgccagcccctcccccgtcgactcgagccacaggacaaggcatcccaaccgccgcccatctcctatcgtcatctgccgatccctcctcggttcctcacagtcacagagcctcacgtcacgtgtacctcccccaacccaacccagcccaacccagcccaaaacctagcgggcgaggggccggggaaccgaccgccggacgcggagatggaccacgcggcggaggcgcagcggacggacctgatgacgatcacgcggcacgtgctcaacgagcagagccgccacccggagtcccgcggcgacttcaccatcctcctctcccacatcgtcctcggctgcaagttcgtcgccgccgcggtcaacaaggccggcctcgccaagctcatcggcctcgccggagagaccaacgtccaggcaagcacggcaccaccacacacacactgactcgcccgccccgacgatcaccatccactccgcgcctttcgtgcgtactctgctgaattactgagcccccccctgacggtgggcccggggcttatcacagatggacctcttcctagctgcatgctgcatctttttagctgaacggaacctactaccatgcatcgaatccatcgatcactatgctctctaacgcaagaatagactgctcttgctcttcaatcaacagttcaacacacgcacgcacgatccaaacgatattcgtctatctggcacagtttttttctctcttcagtttacctgctctagctgctcgtcgttgacattcaggagccaccccaaaaaaaaaatacagggcgaggagcaaaagaagctggatgtactgtccaacgaggtcttcgtgaaggcgctcgtcagcagcggccgcaccgtaacgcgctctcctacactacatacacatacacccgtacacgtcccaggttctcggcttaggcattgactttggcactctgcgctttcttgcgtgcagtgtgtcctcgtgtctgaagagaacgaggaggccatcttcgtcgacccggccctccgcgggaagttcgtcaatcctttgctcctccatcccgacctcgtaaaagttccgcaacgccgtactgtcgctttccctgatcgcgtgttagttctctctctctctctgttcaggtactgcgtctgtttcgacccgctggatggctcctccaacatcgactgtggtgtctcaatcggaacggtgtgtcactgtcactcccggtggtgtttcaaaccttcttaccatcgatatatcatatatatatatatatatatatatatatatatatatatatatatatatatatatatatatatatatatatgctgctatattcggttctgctctctgcagatctttgggatttacatggtcaaagacaaggacaacgtgaccttggaggatgtgctgcagcctggaacaaacatgcttgctgctggctactgcatgtacgggagttcatgcacggtaactatctattgctagatccactttagtttttacgccccggccggccaattcacttcgactcgtcttataactgtatcgactgccgttaccaactatggcagcttgtgctgagcactgggaacggagtcaatggcttcactctcgatccttcccttggagagttcattttgactcatccaaatatcaaggttaatgataaaaaaaactccacacttcttttctttcctggctgatcgatacccctggttagcactataaaacaaaatggtactacttgagtttgggtatcacgttttgtgcgtgcttcgttcttttcttgtgcagataccaaggaaagggaagatctattcagtcaacgaagggaacgccaaaaactgggatgggcctacagccaagtacgacgagctagggggctcgtttctgtccaaaaactactactgtgatttcgtaacaagccaggctgaattttatgccgtttcagattcgtggagaaatgcaagtatcctgaggatggttcaccgcctagatccttgagatatatcggaaggtgatccattgctcgttctcgactgtgtataccggtgtctcacagtttgctttcttctgcggtcatgaattgaatgtgtctgaagttttattaagaataatagtgcttgctcaagctattggtatctactcgtttttttcttctttttttttgtttaactaaaacggttgaatctatgttgttgtggacttgtggtccttgtgaatggtttgcagtatggttgctgatgtccatcgcaccttactatacgggggcatatttttgtacccagcagaccagaagagtccaaacgggaaactacggtataacaaagacaacaatcttttttttacttactattactactcccgggactgtagtttagcttcctgtcctcacactggttggttctatgtggaattgcagcgttctgtatgaagtcttcccgatgtcattcctgatggaacaagctggaggccaggctttcacaggcaaacaacgggtgtgtttcagtttccctttctcagaccccaatccccaactgaaaaatcttgatgctagagctatcacatttgcctgagatatcagggggaatttcaacacttttacaggttgaaattattaagaaaagagcactattttaacatgccatgtttttttttaccagtggttggcattgcatataactgaaaatgctcctgctaaatttataatgcaggcgcttgaacttgctcccgctaaacttcacgacagatccccagtgttcctcgggagctacgatgacgttgaggagatcaaagcactgtacgcttcaatgtcaaacagcggttgacctttctgcctgaggaaacgagcgagatcaaaagcaccgtacgcttcagagtcaactgcttgatctttatagattgtaataaaataataaaagagtttgtaaaaaaaaacaacaacactgcttgatctttctgcatgaggataaaaagcgcatagtttccccggttggatatatccatcagatatttattatgttgttgccttctacacaaatttaacgtgctttcgtgattccttaatgcaactttggattcatgtacggagggagtttatgtgaagacatattacttggtgcagtttatctccaacaaaatacaaaaaaaagaaccttgtgcagttatacttcagtcttaatgtcgtgttcatcggatttgtgacgctccaaagcatagtcgttgcagatccttgattcgaactcagccctctcgaaagcagtagagatgcgagatgtacaagccagaggaacactctcgacagcagtagagatgcgagatgtacaagccagaggaacacacgacagatataggagaattctctatatttattattagggtgtattagtgtataattgctttcatacaaactataaacccctcaggcttagtttgggtactctagtattgaagtggtttggagggattagagagtgtataaatccccaataagttaaaaactcccataatacatctcaatccacttgaacccctctcattactagagtatccaaactagccctcaagtgtagtttcggtattaaactataagatctcctttaggatttttcaacatccccccttagacgagtgcggtgattacttatgtctcatcaaaactccgaaaatctagtggtaaaaaatagagaaaaaagagcataatatcactcgatgaatctagtagtaaaaatggagaaaagagagcataattgtcactcgatgatttgtacttgttgcctcgttaaaaatcatatatgagaaactttagaaaaaaaactcataatgggaaaaataatacaacatgtgtcttcaacctttaggatgtatagtatataatcttcagggtcgaatagcaaggactaaaattcagaggtgatctccctctgaatgtggcatgtctctcaagtgtttcatctctatacatcgtacaatttttttgaatgcaactgtaagggttt

SEQ ID NO: 664 - protein, 342 aa, Zea mays
MDHAAEAQRTDLMTITRHVLNEQSRHPESRGDFTILLSHIVLGCKFVAAAVNKAGLAKLIGLAGETNVQGEEQKKLDVLSNEVFVKALVSSGRTCVLVSEENEEAIFVDPALRGKYCVCFDPLDGSSNIDCGVSIGTIFGIFTWSKDKDNVTLEDVLQPGTNMLAAGYCMYGSSCTLVLSTGNGVNGFTLDPSLGEFILTHPNIKIPKKGKIYSVNEGNAKNWDGPTAKFVEKCKYPEDGSPPRSLRYIGSMVADVHRTLLYGGIFLYPADQKSPNGKLRVLYEVFPMSFLMEQAGGQAFTGKQRALELAPAKLHDRSPVFLGSYDDVEEIKALYASMSNSG

SEQ ID NO: 665 - DNA, 4673 bp, Zea mays
caccctcacggccaccactgatttaagtgtaaaaaatacactctattgcttagataggtgttaactcgcctaacgaaaaaaaagaaagcatctaaataggactatgagtatagagagtagttgcctcgtttgactgacagcctggtcttggactcttggtggaagctggatcgctagtctttcttggtctacaagacaaacaacaaatgaggcaaatggatatgaaggatccttttgctttgatttctttgtagtccgcgtagagtagtacgtatactcgtactaccatgcatgtgtgtttgtactcccgcatagagtagcagtctagcacggctatttcgtactaccatggatatgatccacgtgggggtgtgaacggaatatttcaactcaaacgttacaagtattctaatcaggtgcttgtacgtgtcatttttatttatgtttgagcagtataaaacataaagattggtgtgttttgttggctaagtaggtgtaattaaagtcaacaactatggttcaaatcttatttatgtgtaattttaggttttttataatatgaatggaagagaacaggtgacacacaataatagtgaaaattgattcttttttatagtagagtataatttaattaaacatattagtcagttttattcatgcatgtatctagtgggaaagtgaaaatagaaaaacaaaattgcaagatttccatgtctcagtgagacatctgatgcgtgtaccaatttcgcatcacaagtagatacagattttagcgtgcaaaacgttacacgtgagaaccctaatgacacaggctgcttccaaccataagaaaaaaatcacggggtaattaaaaccattcgacttggagaagaagaaaggacctcctgggtttctggaagcccggggaagcaaggctccttccccgtcactgacggggcggatccaccagtcctgtataaaagtccttccccaaaacatccgcctcacttccaaactgcaacgaaaacccacgtctaaaacaggtggcccaccaacgattcacttccccgatcccagggggcggcgatcggaattcgcaacttctcccacgcggcgaacacggcagagatgatgagctcccgggccggatccatcctcctccgccacgccggctcccgtctcttcaccgcagcggcgatctctccggcggcggcctcgaggccactgctcgccggcggcaatggtgttccggcagtcatgctacggcttatgtccacgtcctcccccgccgctcccacggaggcgaaggacgaggcagccaaggcctccaaggtgggaggagacaagaaggcggtggtgatcaacagctactgggggatcgagcaaaacaacaagctagcgcgggacgacggcaccgagtggaagtggacttgctttagggtacgcgccctgccttctcgggctcgctttgatcattgtgcagtttatctgccctaatttgcggttcgtctcggcggtggatcgattcgcgctagttgtgagtgattaatctgttgtttttgttgaagccatgggagacgtacacggcggacacgtccattgacctcaccagacaccatgagcccaagacgctgatggataaggtcgcatactggaccgtcaagtcgctgcgcttccccacggacatcttcttccaggttcgtgcccacgcgcgcacgctctctgttcaatagcgcggatgatcagttcggcttgcgtttctaattagtaggatcactaaaaactgattatactagtacatgcgccatgagaggttaagcataatggctcctggctgtgctcctgctttgtgggaagtcgcagcttgtatttgcaatttgcaacgtggatgaaatcgagtagtttacctcgaccacttcggggacccgattttattctatcgacgaaggtgggcactgccgcactgagcagtgacgactgacgcggacatcagcaaatggatctataatggtatggcaaatggatctatgatggtatggcagcctagagctgaaagttggatgttggtcccggtcatatcttaatttgagctaacttttttcaggtcgacacgatatgaaataattttgagctagactatattgtaactagatactaagaaaatagatctagctcggtccgaaacaaggcggaccgatgatcatgcagtgctggctcatacggaacacgtaaaaaacttatatatatttgtgactttgctatagacaaaattatataagaaagagaaaccaatgttttctataacttttgtaaatagataaaagtattggagcataaaataattatttaaacattagttttctaattcgtatctcacttcgtactatatcgcctttagcatggtccatttaatcatatcgtgtcgtgccagtgatcttgactaagtttgaggcatgacatggtgacctattttttcgtgctgtattgtactttagactcttattatttttcttcgtgttgtattgtactttagactcttattttcgtgccgtgacgtattagccccggtccaaactgcagcccaataaaataaaggcttgctgatatttgtttgtatcagcaattcatctttttaatctggcttttagaacttggttcgtagatgcatgtcgaaatgatctgcatattttgaaggaaggttgaaaggtcgatcattcatgtgctgttgtaagctgaccctgtgaattgggcgaattgtctgcagaggcggtatggctgccgggcgatgatgctggaaaccgtggctgcggtgcctgggatggtgggcggcatgctgctccacctgcgctcactccgccgcttcgagcagagcggcggctggatccgcgctttgctggaggaggccgagaacgagcgcatgcacctcatgaccttcatggaggtggcgaagccgaggtggtacgagcgcgcgctcgttatcaccgtccagggcgtcttcttcaacgcatacttcctcggctacctcttgtccccgaagttcgcgcaccgcgtcgtcggctacctggaggaggaggccatccactcgtacaccgagtacctcaaggatctggaggccggcaagatcgagaacgtccccgccccggccatcgccatcgactactggcgcctccccgctaacgccacgctcaaggacgtagtcaccgtcgtccgcgccgacgaggctcaccaccgcgacgtcaaccactttgcatcggtacggatacttccgaattccaataccagcaactctgcttgatctcatctcgttatgggattggttctgaaatctgaattggtatgagcttgtgccgtgcaggacatccattgccagggaatgcagctgaagcagtcccctgcgccgatcggataccactgaggatgtttgtgctcttcttaattttgcatcgctaataagcaattgtctttaagggaaggaaaggatgcttattgagttacgagtactgctacggcgattaggatattttccaaccagttgtttgagagtgaaacctattatatgtacgcatgttacatgtacatatctctaagtgcgagaggtgcttttctggcgtttatcacttcttcctggagttcctttgttcttcatgtcagctgaattgggctcgctaatatcgaatgtacaatttttgcataatccctatcttgtttgtagataatcagttgtgcttaatttcattgtcgttgtttgtgattggatagggatgacaacaagccctaaattttatactataaaatttaagtatcaattaggatcgagcgtatgttcaaatcagattatgatcgagctctatttttattaaatatttgaattagaaataatttaggattctaactaaggccctgtttgtttcaacttatagattatataatctggattatttgctctggattaaataagctaggtgctgctgtttgttagctcggattatttggacttgacttattattcatatgcatgcaaatacaataatacccttggctgttttacttgtctggtttcatcagttggcactacgcagtttatacacaacaatttatacacgtttatagatgcttttttccaaatagctcatacacgttttgtccaacaattgtttaatgcgtaattttaaaaagacaaataattcatacatgttttgtccaaaccaaagtactcaatataaaattacattctcatatcaaatagtgcattggcaatttgatctcgaaagttattcatgtctccctcttcttctcccaattggccttcagcattgtgatgacttggaggaatcggcatatagttctcgtcttgatcacaacgatcaaactcatcatcggccattttactatctcaaatgaaattatgtagagccatgcatgcatgtattatttttgattgcttcaatatcggataacttggcaagtccaacaaaattctccacttcatcttcaatacaccgaaagaacactcaatgtgattacaaagagaagagtgcaattggttgaatacctcctctatgcttctctcgctcactctgaagctctcgctgatagaggcagcaagtaccaacggaacgtacctgtaggtgcgccagtgctggactcgagggagacggagctgcatccaacgccggtggctcccgtggtgcctc

SEQ ID NO: 666 - protein, 329 aa, Zea mays
MMSSRAGSILLRHAGSRLFTAAAISPAAASRPLLAGGNGVPAVMLRLMSTSSPAAPTEAKDEAAKASKVGGDKKAVVINSYWGIEQNNKLARDDGTEWKWTCFRPWETYTADTSIDLTRHHEPKTLMDKVAYWTVKSLRFPTDIFFQRRYGCRAMMLETVAAVPGMVGGMLLHLRSLRRFEQSGGWIRALLEEAENERMHLMTFMEVAKPRWYERALVITVQGVFFNAYFLGYLLSPKFAHRVVGYLEEEAIHSYTEYLKDLEAGKIENVPAPAIAIDYWRLPANATLKDVVTVVRADEAHHRDVNHFASDIHCQGMQLKQSPAPIGYH

SEQ ID NO: 667 - DNA, 3232 bp, Zea mays
ccccctccccttgcatgccgcctgtagggggcactctacggtcgcagcggtgccccctacagcgtcccctacgcgccggcccccttctccctcctccagatatagtgtgtcactgtttatccccctaaacattgtgctgtgggtccacgagtaattgttagtagataaaaaattgatagttaatataaaaaatgatattttatagttgtagtgggatatatggggagtatttagggggaactgttgcgggagatgaaaaaatagagacaaaaataggagaaaaagtgatatagtgggaaaaatttagaagtaactgttgcggatagccttcacttggtggggacactcctaccgtgcctcgccccacttctagcctggcctagcctaacgtagcgaaacgtaagcatcccatagcctgacgtggcgcgctccagaaccacccgacctagccgccggtggccgacacgccgcatagccccctcccactccgtgcacagcgaccgaatagcccacgggaaactccccgccgccgcaacgtcaccgacgtgcgggccggggaccggctcggcgtatggcgcgctgacacgtcgtcacgcggcagaggcgggggcgccccgccgctgtcaccgatcgaccgcgcaagagtccgcgcgcgcgtacagcacggcggccggccggccggggtcctgtcgccgtcgccgtccgtcctgacttctggttctctcaatttcaaaaccgacgcaccgcatgctgtacggggctgggttggccactagcagcgctgacgcggcgggcccacgggaggtcgcgtcgattcgcagcagcgcgccgcccccctccccaccaccacgtcaagcggcgtgggcttccgcccctccctgcccgccgcgtgggcccccactcgcgtcctgtaaccgggatagcgtgagcacgtcgctatcgtccgtaacggcgaccgcgaccataagagaggaggcaaagccagcccccggcgggcggtaaccgcccccctcctttcaactcgctcgctcgttcgccttccatctttctccctctctcggcagtctgcagcaggccagcgccgtcgcgcatgcaggaggcgtcatcggcggcggcgggggccgagcccggccgtcgggcggcgcagcatcagttcgccggcgtggacctccggcggcccaaggggtacgcgccgccggcgccggcggtgagcgagggggacccgtgcccgcggtgtgcgtcgcgggacaccaagttctgctactacaacaactacaacacctcccagccgcgccacttctgcaagggctgccgccgctactggaccaagggcggcacgctgcgcaacgtccccgtcggcggcggcacccgcaagaagccctccttgtcgtcgtcgtcgtcgtcgtcctacgcggccgccgcggacgccgacaggcagcccaagaagaagcccgccagcaagaagcgccgcgtcgtggcgccggccccggagctcgccgccgcggccgacccaggcaagacggcacccaccacgacgacgacgacgacgacgacgagcgagatcaccacggagactggcgcgctggaggactccgactccctggcgcacctgctgctgcagcccgggacagaggacgcggaggccgtcgcgctcgggctcggcctctccgacttcccctccgccgggaaggcggtgctggacgacgaggactcgttcgtgtggcccgccgcgtcgttcgacatgggcgcgtgctgggccggcgcagggttcgccgacccggaccccgcatgcatcttcctcaacctcccgtgacagccacagacggtcacggcgccgaggcgtacgtcctcctgctttgctctgctctgcgcctgatgatgagtgcaaggaaatggagcgctttgattcttctgctattggttgcatctgctaattgatttagcagtggtggtaaggtacacgcacgacgagctgactgcgtggttcttggcttgggccttagtatatgatgatgatgatgatactagttgtatgtgtgacgtgagagacgatcgcgacgacgaccttgaattttagtttctgagatgagaaaggtcaactagtggcctctgtatgactttagttttactcatgaactcatcagatggctggctatggctgtggctgtggctaactcatcgtcaagtgtttctaccggctgcctataaactagactgagctcttgttggtctgggattcttccttgttcttatgataaagttctgttgtgctgtcatgcttgttttcttcttttctgtgaagaaaagatcatggggaaaaaacattctaaattcgtcttcctcggctctcaatctcatggtgcgcgcgcgcgcgcgcgtgctgtgtgtcccagagccagagtcgcaggggagcatggatgctgaaagctgtagttagcactcgccgccataatcgatccgccggccggcgacggcgatcgtggtgctgatcggttggcatggcatggcatggcaggcacgtctgctgcgactttgtcgcggcaagacgattcgccgggcggggcgctcggttccgttccagttccaggcgtcggaagaacattgtcagcgtccgtcgatgcccggcggcggtggtcgtgctccactcctgcggtcctgcctgtcgtcgtgacgctcgcatcgcattcggattcgcatccaaccaatccagtgcaggtgggtttgtcatgattacgagccgagcagtgtagaccgtccggcgtccaggccagcgggcaacgccacgcggcgggggggcatccggttcccgacgccatcattttcgcccgccgaagcctgcccgcccgcccgccggcgccgagtgcgactgcggtcccagaaaggaacccattgctaggcggctcaaccactgcgaatcttcgatgatcttcgacgggccgggaacaagtacacctacgcccacacgcccagtggccgcgcggcctggtgttccggttgcacgtcgacgtccgccatccacatctatggtggatcgtcggtgagcccgaggcgtcggcacgggtcgtggcgggtgtacgacgtcccgctcgcgagctgtcggcgccagcagcatcagcggctgctgccagtcgctccgtgcgtctggccgtctgcatgccggcggaggggcggcagtggttcggcgaacggggacgtataagactgaccgcagcggtctaccctaccgctcccc

SEQ ID NO: 668 - protein, 240 aa, Zea mays
MQEASSAAAGAEPGRRAAQHQFAGVDLRRPKGYAPPAPAVSEGDPCPRCASRDTKFCYYNNYNTSQPRHFCKGCRRYWTKGGTLRNVPVGGGTRKKPSLSSSSSSSYAAAADADRQPKKKPASKKRRVVAPAPELAAAADPGKTAPTTTTTTTTTSEITTETGALEDSDSLAHLLLQPGTEDAEAVALGLGLSDFPSAGKAVLDDEDSFVWPAASFDMGACWAGAGFADPDPACIFLNLP

SEQ ID NO: 669 - DNA, 4793 bp, Zea mays
tcaattcaaattcaaaaccctgttttaatttttatgatctcaaatataattctaatgtaaagataaatcctctttttattattatttaatccaccctctattatttaattatggaggtaataaatgactttattaagatttccttcctcattttctgttttcgaattaggtttccattcaaacccaagataaagtttaagaatttcaaatttaatacgcactcaaaattattcatgatgcgatatatttattctaactaatttatttatttgataaatgtttgaaatatgaaaccattcatatttttcctttatttttaggaaaatagtattttgattggggaacataaatttaaagttacttcaaacctactattcatataaataaatgattatggtgtatcatttaatgatatgcataatcatttagttgaacagaaaacttttctattacctattttctaaaataattctcggttttcaaaattcagtcctcaaattttcaacactcaagtataatttgagatatctgaattttactcttttatgtcctcttttatttatttatttattattattatttatacaatttttgggccttacatctcgcgtcaacaccttcgaacaagccgaaggtatcaatgtgatattccatatgtttatcatgaaataaagatatgaattgatacatgtatgaataatgcttatcatctatatgaatgcttatttccgcaaatgatgaaggtgtgtcattcatgaccttagttcgaataccattatatccgaaaggagatgatgcttcggaggacgaaggtctctaatctttaataattgtgttgtcttattgttaattcacagtatttgagaacaagagaccatcaaattctaaacacctctggctaacactctaacgaactgttagctagcttatagctaataattaatttattagttggatcaaactagctaataatttgttagttggctaactattaactttatagaggttgtagacagatcctaaagaaggtagcagccactattatttgggaaggaaaacatgcgcctagatggtatggtccactgcaggcagcgacttttgtggtcactcaatcacacctgtcactttcagatgcatgtggtagttctatatgcatgacctggtcgaattcttccaatgcaggggtcttggtcttggcgttaccgcgtcccacaaaagtcatccatgcccgcttgttactacaacctcaatcacaaccacaagagcaagaagaagaaaaatgaaacagcgccagccaatggcctgcaaccgccgccgcaagcttctctgcgcctgtttgctgctggcttgcgcagcccccgccgccgccgccgccgtcaacatctccgtctactggggccagaacagcaacgagggcagcctgggccagacatgcagcagcggccgctacgccttggttgccatggccttcctttccacgttcggcagcggccagacaccggtcctcaacttggccgggcactgcgaccccgcgtcgggcggctgcacagctctggccgcggacatcgcggcctgccaggcgagaggcgtcagggtgctcctcagcatcggcggcggtgctggaagctacaacctctcctccgcctcggacgccgagagcgtggccacctacctctgggacaacttcctcggcggcacctcctcatcgcggcctctcggcgacgcggtgctcgacggcatcgacatggacatcgagatcagtccgtccagccacttcgacggcctcgccaggaacctaacgtcgctgtacgggggcgacaggcgagggaggaagtacctgctcaccgcggcgccgcagtgcccgtacccggacgcctcgctcggcgcggcgctcgccacggggctgttcgaccacgtgtgggtgcagttctacaacaaccccgggtgcgagtaccagcagaaggacggagacggcgtggccaacctggcggcatcgtggaaggcgtggacgcagtcgctgccgtcgtcggcgtctgtgttccttggcctgccggcgtcgcctgctgcagcgggtagcgggtacgtacccccggacgaccttgtgtcgcgtgtgctgccggcggtgagcggctccgctaactacggcggcctcatgctgtggaaccgctactacgacaacagcaccggttacagtgcccggattctgagcagcagtaagtttgcgcacatttgattactgaatggttcacaaccagtatgttttagagaaagaatatcgatctaacaactcaaccatgcatcacagtcacagcggatcgaccaaacagctcgccagttccagggggctccggcgatgaatcgccaccgccggacaactcaccagctccgccgccgagcactggccggtcacgaaagagaaggatcaaaacatgtaagtagaatgaccattgcttaaccaaccatgtgggggcatcaccctttcgaatctcgagaatgaaatgaatgatttcactggcattttcagatatcatagcgggcaccgcaggcgtatccgggctgtgtgcaataatcgctctcgcagccttgatgtggtggtacaagagacgttatggcatggtaataccatggcgcagaggcgtatccggggtcgaatcctttctgcaaaagcaaggagctctactacacccgaaaggctacacttactcggaggtgaagaggatgaccaggtccttcgctcacaagctcgggcaaggcggctacggcgctgtctacaggggcagcatgcctgacggccgtgaggtggccgtcaagatgctgacgggcatgctggagggcgacggcgaggagttcatgaacgaggtggcgagcatcagcaggacgtctcacgtcaacatcgttactctggtagggtactgcctccagggtccaaagagagctctcctgtacgagtacatgcccaatggctccctcgagaggtacaccttcggcagcagcagtggagaagacgccttgagctgggacaggctgttcggtatcgtcgttggagtcgcgcgagggctggagtacctccacacgggctgcaacacccgcatcgtgcacttcgacatcaagccgcacaacatcctgctggaccaggacatgtgtcccaagatctcggacttcgggctggcgaagctgtgcgggcagaaggcgagcagggtgtccatcgccggggcgaggggcacggtagggtacatagcgcccgaagtcttctcgaggagctacgaggcagtgggcagcaaggctgatgtgtacagctacggcatggtggtccttgagatggtcggagcgaggaagaatgtccatgtcagtgctacagacgacggcggcaacagcagcagcagcaggtattttccgcaatggctgtatgaaaacttggaccagttctgtcgccccacaaccacgagcaacggcgagatccgcggtgacgacgacgacgccacggaagtgctgctcgtgaggaagatggtcgtagttggactgtggtgcatacagtccaaaccggacagtcggccgtccatgggccaagtccttgagatgctggagagcaacgccgccgacctgcagctgccgccaaaggccttgtgcaccgcttattaaaccgagtccgatcttgtaaaaactctagtccagcggcgtaatgcattcattgcttacctgctatagatagatactactgattcgagctcattgttcttcactccaccacgtcctttgttctttcaaagatgacctcgtgggtctatcttttgcactctttttgtgaccttctatgctgcttgcgctggctttcagtagagatgttctgtgtgcgctgagacagacagcacctcgaccctcccttgcacatccttcaaccgctccttacacgagtaaataaaacattatccacctattcttcctacgatcaggcagagatacctcccacacaaactggagaccatgattttttcccccacacatttgagtaggcacccaagcctctaagctacgtgatacagaacaaagatgatacccaaaaccttttacactccctctgacattgtgtgcgctgccccccacccccaccattcaccctcaacacacactcacaacaaccttttacccactatatgacattgttttcctatattttttcccctggaattgctcaagtgaaaaagggaacaccgagtacaaattccatacgaaaattaccaattcacaaccatcatgtgatgtaggaataaccacagagaacaagaaccagtagacttacaatagaaggctgagtagtgctcaattcatcctttgaaaatgacaatagcattccattcgccgatcttacccataagacctggaaaattgggttttggtgcagtgaaccgcgccctaagtggtgcccgctttatgggtaagtgctctgtgggcttcttaataacttttacagcctacaagactaaagtagttttaacttacagagcatgccacaaagtagttacccagatcaaagaccaacctgtattcaggctaccaatcacgcccctaactgtccaggctctttatgctctatagctcctgataacttttagaaacagaagaaaaatagagcgagatgctagctagaggaactttaactggccaaagtagccttacagcaattacaatgttccatatgcaggtaatgctgacaagtttttaactactatgctatataaacatacaaccaataatcatttgttgaaatatccaaattcaaaatcaaggtgtattac

SEQ ID NO: 670 - protein, 767 aa, Zea mays
MHDLVEFFQCRGLGLGVTASHKSHPCPLVTTTSITTTRARRRKMKQRQPMACNRRRKLLCACLLLACAAPAAAAAVNISVYWGQNSNEGSLGQTCSSGRYALVAMAFLSTFGSGQTPVLNLAGHCDPASGGCTALAADIAACQARGVRVLLSIGGGAGSYNLSSASDAESVATYLWDNFLGGTSSSRPLGDAVLDGIDMDIEISPSSHFDGLARNLTSLYGGDRRGRKYLLTAAPQCPYPDASLGAALATGLFDHVWVQFYNNPGCEYQQKDGDGVANLAASWKAWTQSLPSSASVFLGLPASPAAAGSGYVPPDDLVSRVLPAVSGSANYGGLMLWNRYYDNSTGYSARILSSITADRPNSSPVPGGSGDESPPPDNSPAPPPSTGRSRKRRIKTYIIAGTAGVSGLCAIIALAALMWWYKRRYGMVIPWRRGVSGVESFLQKQGALLHPKGYTYSEVKRMTRSFAHKLGQGGYGAVYRGSMPDGREVAVKMLTGMLEGDGEEFMNEVASISRTSHVNIVTLVGYCLQGPKRALLYEYMPNGSLERYTFGSSSGEDALSWDRLFGIVVGVARGLEYLHTGCNTRIVHFDIKPHNILLDQDMCPKISDFGLAKLCGQKASRVSIAGARGTVGYIAPEVFSRSYEAVGSKADVYSYGMVVLEMVGARKNVHVSATDDGGNSSSSRYFPQWLYENLDQFCRPTTTSNGEIRGDDDDATEVLLVRKMVVVGLWCIQSKPDSRPSMGQVLEMLESNAADLQLPPKALCTAY

SEQ ID NO: 671 - DNA, 6963 bp, Zea mays
ccaatccttggacttcttctgttcctgcttgatgcatgttcaactcgaattttagactttttaggatttgaaaacaattttgctatgtgttcatcttcagttttgagtgatcagtaatgctgaagattcaaaaaatataaaatttcttcttttcttgagtaaacctacatactataaacttgtactgatatgtttttatcattggaatagcctggtttgccgctcttgcaacaatatctgtctcggtttgagaaattagttatggagctcatgccaaaattgggagaacactttgttgaataaatgataaaccgaagcatgtatggaagccggtggtttatcacagttttctcatgttccttcccatttcatctaactcttagaattttggaagcaagatatttggatgctctgctttttctgtagctgatcctacatcttgtatagtctaacatttcgttctttcttggaccatccgtttatttaactgaggataggagtggatagagacttctcggattacaatatgtttgaataactattccattaaaaaggtctacttgtgatatataaaaattgtagcaacacacaattatctaactatatttatattttttgaggtatgtaaacatccccttttagtgatgctaataaaaagtgtcgaataacaattagtgtttttgtatatcaatatattttattatagtgctttcttatcttaatgtatcttagcattacatgttgaccccgtagcaacgcacgggcatacacctagtatatatataaaaaagtgccaaacttgcaatcctccatcttctaaaataaagaacatagcacgaggaaattggcaagcaagtccatcttcagcgtccatctgagacattttttattgcaaaaaccagagagtgacttttttttgttttcaaaaccgcggctgtggtcggcggccccccggtctccttccactcgctttccggcgggcgactggcctaaaatcgcctcttgtttgtttgcttccgtcgtcccctctccacgtagagcacgcccccggaccaccttttataagcaccaaccatctggccttgccgcgccgattcgccacgaagccgcactgtgagagagggacgcggcctgttgtcccggcttttagacgcaacttccatcgctgcgaagctatccattcgtgttcgtcatggccgccagcgtcaccgtggaaaacctcaaccccaaggtgagatcgccgcccgttttctcccccttgtctagctttctggtccttgaaggtcccattttttatggatttttcggtgggaagtttgggttttaacgagatggaggaggctctgtggatcttctgcgtccctctgcgtgtccctgattcagcttagccgcgggttggactctcgtgtgattgagaaatttggggtgaaaagattatccttgatttggttgagcggtacaagtcgtgcttagttcttgttcttgatgatctgattttgatttatacttataaatcaaacgataaaatttttaggataattgtaaccactgcaccggcgcaaagttacatcgtttatatgcttgcaataagtgcagttccttatacccagatcactagtcgctaactcgctatcgctatctctcaaccaagagttagatctcagcgcgactgcgattcgagctgctatagtgccttttctttttgttttgttttgtcgtgagtcgtgaccgaatagtttaagtcatctgtcagtatccttttccccctttgactcaaaaggggatatggcgatttgtttggactgctgccccacttctgttgcacaatatatataggttgatgctgtattgtttctgtgagatctgactatctgaggtactactttgttggcaatctgtgctttgttactaaacctattttgtaaacctgctgaatgtcgtgtgatcatgatttccatctgtttcaaagacaacagctttcgtgctttgcttctctgggtaaggcgagtgtggcttctcatgcctagctaatacactaataactattacaggtcttaaaatgtgagtatgcagtccgtggggagattgtcatccatgctcaggtatcttgactactgatgttcaacaaggcttgcagtctagtacttcagtatgttatatatcactgtgttcatgttcccaaagaatcgtttattcaccttatcacaaggcaatacagttaaatcaggcaatgttcttatagagttttgttagactgttgtagtaatagtatttgcttttgacactgctatctgacaaagaacagcatagtgcagtacctgaatttacaaacatgtatttgtgttagagcttactttatagctttcgaagtctattttggtacaggaaagtaattaagcatgtagtctacttgattgctaataaccatattgctttattagtaatttaatttgcaattgttccctgatgaaattcttcctaattattgaaggtcaataatctttttcaccatatattatatgtctcattgtgaatgcttttaattaagaatcttgtgcgctccatgccattggcagatctgccattaaggatctgcttcgaaattgatttaatgtagccccattgttttttctgttaacagcgcctgcagcaacaactacaaacacaaccagggtctcttccttttgatgaggtacctaactgttgatttaaaagttcattgaaagtgcctttatctttcctttttttttcaaaaattatatagtccgttccaattatatttgtacccttgcagatcctctattgcaacattgggaatccccaatctcttggtcagcaacctgtgacattcttcagggaggtatgtgtttattttaccttcagattccacctttgtttcttctatatttacatggtaccttgcaggttcttgctctttgtgatcatccgtgcctcttggaaaaagaggaaaccaaatcattgttcaggtgaatatcgtcatcattcaatttacagaactcctaaattcagagatctagtgcgtgatatcctgctatttttcccaacttcagtgtcaaagcaacctaaaaattctaaaaaatacagagatagggcaatctgtcttcctttaaaatcaaagctgtggcattttctttgaaattagtaaacatttatataaatagtaaaatttcctggagatctgtcaggtatttaactttttcccttcaacttccacagtaattaaacatacctaggaagatagttttagagttctcatgtttaattgatctgttcatcagaagaaccattacatcattgcctaattatgcatgccctttaatttttcctaaaatttcccttgataccatttcaagttgcaaagatgattttttttcttcgtactgtttaatatttttgttagccataaactttcaaaagtagttcagtgtcccatttatacataaattcttatgtgtacttgatgggtcgtctcactgcagtgctgatgcaatttctcgagcaaagcagattcttgcaactattcctggaagggcaacaggtgcatatagtcacagtcaggttggcatctcactctgatatatttattgaccacaatgagagaggagtcttggcttcatttgattttttaatgtttcctagggtatcaaaggactgcgtgatgcaattgctgctggaatcatgtcacgtgatggattccctgcaaatgcagatgacattttcattacagacggagcaagtcctggggtgtgcatttttaacttctctttcaattgtcctggacattttctgaataaacatgatatcactgaagtctcatcttgaccttattcttccttcttaaggtccacatgatgatgcaattactgattaggaatgagaaagatggcattctgtgcccaattcctcagtaccctttgtactcagcctccatagctcttcatggtggagctcttgtatgtactttcatttgctcagcagaagaatatggtctatagtactaaatattgtatcaatgacacctaaaatcgagcgcatgttctttcaggtcccctattaccttaatgaaaaaactgggtggggtttggagatctctgatcttaagatgcaactggaaaatgctcggtcaaaaggcattgatgttagggccttggtggttatcaatccaggaaatccgactgggcaggtttgtaccaatcatttctcctctctcgttaaagaacatctctgcttgcttagatattctatttcctatgcacaacatactctttataattgagtgtaattacatgaagtgtgtatttcttgtactcccgtttttaagttagtgaatactttgtatacttattttgtttagggaaaactttttgagtagaaaaaatgtggtttttatcattctgacttctgaaatctgaatgaatgctttttcaaggctggtgaccaaaacacaaattttattgaagtggttcatttatttgtaggttcttgctgaagacaaccaatatgatatagtgaaattctgcaaaaatgagggccttgttcttctagctgatgaggtgagtgataggcaagtagctgatgttagacgtcagaacaacacaaaaaatttgccacgcctctaacactaatgccattttcattgttaggtatatcaagagaacatctatgtggacaacaagaaatttaactctttcaagaagattgtaagatccatggggtatggcgaggatgatctccctctagtatcgttacagtctgtttccaaaggtaaatttatataaccagctactttatctgccttttggccaagtaactggcttatccaaaacattttgttgctgcaaccaggatactatggagagtgtggtaaaagaggagggtacatggagattactggcttcagtgctccagtaagagagcagatctacaagatagcttcagtgaacctatgctccaatatcactggtcaaatccttgcgagcctcgtcatgaatccaccaaaggtctgccatatggaattctttaaattacgccctggttggaattaggaaatgccaaatcgtccagttaaaaatcattgctttattctccaggttggagacgaatcatatgcttcctacaaggcagagaaagatggaatccttgagtctttagctcgtcgtgcaaaggttagcctggttgcatttccactacactcgagtgtcttctttaaaaatattcaagatttttcttttgttcgttttacaggcgttggaggatgcattcaacaagcttgagggattttcatgtaacaaggccgaaggagcaatgtatcttttccctcagattcttctgccacagaaggcaatcgaggctgctaaagctgctaagaaagcgcctgacgctttctacgctctccgtctccttgaatcgactggaatcgtcgtggtccctggatctggatttggtcaagtgagtcaactcaacctttacatactgtaatgtacttgtgcgcctggcctgtttggttcgtggcgcatcggatagtgggttcttggcgatgcatttttcatgtaaatcagtcacagctacttcatttcatgttaacccggtcgtaacgatcgacggtccgctcctttgctggtacttcgcaggttcctggaacatggcacatcagatgcacgatcctgccgcaggaagacaagatccccgcggtgatcagccgcttcagggctttccatgaggcgttcttggccgaataccgcgactaaactgttacgctgtgtgtgagttaagttggaggttcagtagaactgtagaagagctcagtgacagcgcagaaagaggcagtgttagaaaggcttaggtccttcttcacaggagcaacagttgtcttgtctcatcaaggagaaataaaaattttagttttacaacttctcattgacactgttgggttcttgacatggtagagaattgtgtgcactgtgcctggcactgggtcctactagcggcgcaatttaagcgtgaccaggatggcgccatcagccatctctgtcgatattacactgctagctgaaaatgccacttggtccctttcaggtgtttgtggacctaaacctaagttgtcttccttcaggaacttgtggactgaaagcaatagatgcgacctgaatgacggttctttgtggatctaaaagcaagaccaagagactagttatctgactctcaaaattagctctctcattagttaaatttagctagtcatctgactagtaaaactagataaatagtctgttagagtaagatgctatatatagagagtgtaatatttttgaaaagataaatataaagttaaacaaagagccaaacataaatagtctattggagatgctataaggctaatcacaatggagattttatgaggtgtttcatatattaactattggagatgctataaggctaatcacaatggagattttatgaggtgtttcatatattaattagcctgccacattagttattttgatgacatgtcacatcatttaagaaaggaagagttttatgaggttttatggggataaaatcatgttaacttgtttccaaggtcttagaaactgtgtgaaacctctactgagagcgttttgtttcatattcatataattaagtaaatcttactggttatttatatgcagcatttaaaaagtttgttaacatatgaaatagtgagatgaaactctttattgagatgttgtttcatttattcataaagctgatgtgacatttttagaaatagggacataaaattctcactgtgattagcctaagcaagccaaactcaactcgccacacgatccgatttacgatacgacacagtttggtggggtagtagtaattcttcctacgctttaaacgcccaccgttcgcctggattccggggattctccaattcctgcatgcatctccatc

SEQ ID NO: 672 - protein, 482 aa, Zea mays
MAASVTVENLNPKVLKCEYAVRGEIVIHAQRLQQQLQTQPGSLPFDEILYCNIGNPQSLGQQPVTFFREVLALCDYPCLLEKEETKSLFSADAISRAKQILATIPGRATGAYSHSQGIKGLRDAIAAGIMSRDGFPANADDIFITDGASPGVHMMMQLLIRNEKDGILCPIPQYPLYSASIALHGGALVPYYLNEKTGWGLEISDLKMQLENARSKGIDVRALVVINPGNPTGQVLAEDNQYDIVKFCKNEGLVLLADEVYQENIYVDNKKFNSFKKIVRSMGYGEDDLPLVSLQSVSKGYYGECGKRGGYMEITGFSTPVREQIYKIASVNLCSNITGQILASLVMNPPKVGDESYASYKAEKDGILESLARRAKALEDAFNKLEGFSCNKAEGAMYLFPQIHLPQKAIEAAKAAKKAPDAFYALRLLESTGIVVVPGSGFRQVPGTWHIRCTILPQEDKIPAVISRFRAFHEAFLAEYRD

SEQ ID NO: 673 - DNA, 3691 bp, Zea mays
tcattgcctgctagcttctctatttcaagtcataggacataggagtccatgtcagctgctgttgatctagctagagagatcgactaaagatcgactaagctgctatggattctatttttcaccggtagactcatgaatactatacggcctcatcgttatgggctcctagaacacccctaaatctggtcggtagatatacgatgaacaacaatatagaggaaacctatctatctaataactgcgttcgtacgtatatgttggcccgtccgaactcgttaaaacacacatcttctcttacaacattctcacgtgtaggcgatgtatcagcagaagcaagcatataatgtaccatgaatgtatgactaatccacatcatctcaacgacctcgtcttcgacccatcctgttcgctgttgcggccgttcgactgcgggtacgttacgcctagctagctaggtcggcactctgaattattgtctgttcctttccttcctatgagccaggaatgaacagtacgtgctttagtcgtcgttgctactagccccggccggcctcttcccaagctgcagtggccataaggagacgcggcgatcaggccttccttaattttcttctgttccatcctcgctctacctgcctgctgccagtttcaactctccaaggtcaacgccagccctcgcgcgcttggtgtactctagtttagtacaccaatccgcatgcattcttttttgtttgtttgtttgtttgtttgttttgattgacaaatatatgcggcagagttaagaacgaatcgactccgtcgtctcggctagtcgaccgtacatatccacgacctccaaaggccgccaaaacacccgatccggccagccttgtcgtgtcatcgtccagttagatgtcaactcccatctgaatctcctcctccatggcggctttcctataaatacgtcgcctttccatgttggatgtcattccattccagcaggcaacagcagctatagtttccaagggaaagggatacatcacctgctgctctagctctgctatagcgctagcagcaatataatggcggccgtcggcgccccgggcagctctctgcacggagtcacggggcgcgagccggcgttcgccttctccacggagcacgaggaggcggcgagcaatggcggcaagttcgacctgccggtggactcggagcacaaggcgaagagcgtccggctcttctccgtggccaacccgcacatgcgcaccttccacctctcctggatctccttcttcacctgcttcgtgtccaccttcgccgccgcgccgctggtccccatcatccgcgacaacctcaacctcaccaaggccgacatcggcaacgcgggcgtggcctccgtgtcgggctccatcttctcccgcctcaccatgggcgccgtctgcgacctgctgggcccgcgctacggctgcgccttcctcatcatgctgtccgcgcccaccgtgttctgcatgtcgctcatcgacgacgccgcgggctacatcgccgtcaggttcctcatcggcttctccctcgccaccttcgtctcctgccagtactggatgagcaccatgttcagcagcaagatcatcggcaccgtcaacgggctcgccgccggatggggcaacatgggcggcggcgccacgcagctcatcatgccgctcgtctacgacgtcatccgcaagtgcggcgccacgcccttcacggcgtggcgcctcgcctacttcgtgccgggcctcatgcacgtcgtcatgggcgtcctggtgctcacgctggggcaggacctccccgacggcaacctcaggtcgctgcagaagaagggcaacgtcaacaaggacagcttctccaaggtcatgtggtacgccgtcatcaactaccgcacctggatcttcgtcctcctctacggctactgcatgggcgtcgagctcaccaccgacaacgtcatcgccgagtacatgtacgaccgcttcgacctcgacctccgcgtcgccgggaccatcgccgcctgcttcggcatggccaacatcgtcgcgcgccccatgggcggcatcatgtccgacatgggcgcgcgctactggggcatgcgcgctcgcctctggaacatctggatcctccagaccgccggcggcgccttctgcctctggctgggacgcgccagcaccctccccgtctccgtcgtcgccatggtgctcttctccttctgcgcgcaggcggcctgcggcgccatcttcggggtcatccccttcgtctcccgccgctccctcggcatcatctccggcatgacgggcgccggcggcaacttcggcgcggggctcacgcagctgctcttcttcacctcctcaacctactccacgggcagggggctagagtacatgggcatcatgatcatggcgtgcacgctacctgtggtgttcgtgcacttcccgcagtgggggtccatgttcttcccgcccagcgccaccgccgacgaggagggctactacgcctccgagtggaacgacgacgagaagagcaagggactccatagcgccagcctcaagtttgccgagaacagccgctcagagcgcggcaagcgaaacgtcatccaggccgatgccgccgccacgccggagcatgtctaagtctactactaataagatggatcgatccatcatccatgttcacctgctacctacctctacgtgtatgccttgtaacgcgccggaccggagcacttgtttgatacaaaagcacatgttaccaacacatagttgagatgtgccaacgatattcatcatgatgagtgattaccaaaaagatatcatctttggtttacagttgactaatcttagcatgagtatgggtgatgttgtacagcacgtctcttggcttatggtgtgtactaggtggatgaccgtacgttgctacggagtcaacatgtaattataagatacattgagatataaaaggactatgataaaatacattgatatgcaaaaaataatgattgttattctatattttagttagcatcaagtggatgtttacatcatcaaaaaatatagtacaatacccatgcgttgcaacgatatataaattattcaacaaaattttagtgcataacgattacgtgaaagcgaacaacacaaattattatcgacctcactgtcttacatattccatgtgtggctctcactgcatgtccggtgacgtcaccccacgccacggcaccgtcgtgaaggagttgagatctacggatgtgggccccatgtgcgactgtctagaggcgagccaagggagggccgcacacatcccagtttttgtttggttctgttaaggacatgcttagtaagctccaaaaaagttgatctaacataagaattagaaaaattaaaatagttaacagaagatgttgtggtttatgtgattttagtaccaaagatggcagacaatctttggtatccacaaaatgagaagggtcacatccttcaaccacaattgatggtaaaaagttgtctcccatgagccttgagcaagtaatagtaaagcttatttgttccaattgaacagatgccacataccagtgattggttcatagtgaccttgtcactgatgtctttctttttatctaatccataattcttttaatttgaatttccattactttgaagtcgctaggtctgtgctctcagatgca

SEQ ID NO: 674 - protein, 524 aa, Zea mays
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYITVRFLIGFSLATFVSCQYWMSTMFSSKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 675 - DNA, 2983 bp, Zea mays
ggctgcctgcccaccgtgatggcaaggcttgcttgcttgcgtgcctgcgtgtggcagcgacgaggttgaagctacggcggtggctgcttgcctgcgcgcgtgctagcacggcgacgacgtcgacgctgatgctagcgttgctacttttgtttttgttttctctgtgcttgcgatgatgcagtaaaataaacgtgtgtatctcatgtgattgatcgacgtgtgtcggcgatttcaaatcagtaacaatcacatgtgcatccccatcgacttcgtgtcggcgataaatctgctagggatttgtgcttttcatgtatgtgcttgaatagagaggaaagaataatattacataaaatatgagttcaacatctttcttaataccttttgctcgatctccttagtagagccacgtgcgtgataacgtgttaagaaccccttgctaccgagtgtagtccaagggctgcttaactgaataatagtagaacacaaggagacaagagtgtagagaggaactgattctttgttactatatggtgctgctctccaaaggttacatgatatggggatcttctctctatttatagacaaaactagggtttcaggcatatgggccacataggccttcctggcccaagaaaggtttcttaacactaccatcttccaggcgcggtcgtgcgtgcttcaactccttccctccgcctccagagcggataaataaatacggggtctacggtgcacgcgcacgcatggtgcgccgaggggcatctctgcccggggaatgcgcgcaggccatcgctcgacacgcacgtacgtgtcgcccccgcgaggcctcctcgcacacgcgtcgcgccgcacgggcgccgagggaccttgcaattcgtccgcgtcggtgcacacgtccctggcccggcttgccggctttgccctggcctcgcgcgcgacgtgccgcgtctccccaccggacggctataaaaaggcggcgccacctgatcctccatctcacacaagcaaagcagcagcaacagccaacacctaaactaaagaacagtagtagtccctgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaaggtttgtatcctacggccggccggccttgtgatcctcttatcttcctttcacttgtgtgtgctataaacccactactactgcgcgtaagtagccaagaagaactgatcatcaattaaacgattgtgttggtctgttcgtgcagggcgcagtcacggcgggcagacccggagtgagcagctgggccatgaggggtacagcgagatgggcagcaagggcgggcagacccgcaaagagcagctgggccacgaagggtacagcgagatggggaggaagggcggcctgagcaccatgcaggagtccggcggcgagcgcgccgcccgggagggcatcgagatcgacgagtccaagttcaggaccaagtcctagatctgatgcgtgcccccgcttagcatgtagtacgtagctgcaggaatgtagtgtcgtcgtagtagtagggtagtcgtacgacgtgccgctcctcgtttggcacgtgtgccctgaataatgtagtgctgtcagtcgtcgtcctagcacgcgtgtaggagaccatacgtgcgcgtatgatcatgcgtgcttcgcttcagttaggttctgatgttggtcgtcgtcaccgtgtttgaagcaggcaggtctcttcaggctttgtcgtcgtagcagcctgtgttctagctctacgaccccatactcatagcgtgtggtggtgggtcgtgatgccttaaggtctccgagtttgtatccgtgcttgtttcgttaaggtagtttggttcataactcaaatcttctctcacttatgttcgactacattttgtttggagtctctccgttcatatacaagaaagggaaggatgtagctagctagctattctgccacaagagagaaaccagaacggaacggaaacatataacagtagcacctcatgtggcagaattgttggttttatgcctgctgcctcaattttacggcttcactgagtttggacattcatctttctatcgacgagaatgcctaatcaaactagctaggactcaataaactgcaatctttactagcacataggggtctgttctggctcgggaaaaactaaccaaactttaaggactggtttgagaatcccaattttccaaaaactacccaaaactctttaagctctttaaaactagtttggaacctcaattttcccttaattttctaaggaatttctattttttatagaaaaatgaactaattttcattggaaaaatataaatctcttataaaattgggcccttataaaattagggttcccaaactagcccagaaggaactatcacattaaaaactacctagctctaaaaaaaactaccacattaataaagttttggacagctaaatactagtagttgcctcattaattagggtatgtttgatagctctaacactaaaaaaaccaattgcctcgttagctcattagtctgtttgatagctcttaacactaaaaagagcttgcctccctctgaagattgtctgactccgaaaaaccgaaactaaaatctaaataaaaaccgaaagattgtctaactcaaaaaaaaatgaaagattgtctaactcttaaaaaactacgacagtagagtcggttcgcactagttcagatctaccttaaagcaactctaactagatcccactgatgttgtgaaaactgtttgagagctaattaaagcagatgccttcgagcagctccaacttagatctaggatcccgtgcaaatccaccgtagagcagctctaact

SEQ ID NO: 676 - protein, 113 aa, Zea mays
MASGQESREELARMAEEGQTVVPGGTGGKTLEAQEHLAEGRSHGGQTRSEQLGHEGYSEMGSKGGQTRKEQLGHEGYSEMGRKGGLSTMQESGGERAAREGIEIDESKFRTKS

SEQ ID NO: 677 - DNA, 2866 bp, Zea mays
aaaaaaatactcgacaagtgtcaaaaataaaacactcggcaaagagcttctttgccgagtgttttgttttaccgagggtttttgcgtgacactcgataaagagcttgtttgctgagttccgaaaaaaacactcggcgaaatatttagcattcgacgaagagccaaattttattagtgatgagactaaaaaactgtttagttcgtggctaattatattatactttatttaaggttggttgttgtaatcgaagaactaacgttagatatagggcccctttggtagggcttatttttcagcttcggctctggctcatgcaaaagttatgccaaacacctctttttcaaatggcttcatcaatgaagtgctttttcaaaatgaactagagggcatgagccaaaaaaagtggctcacccggcttcagctcacgtcatttttgcacaatagccctcccaccagtccaaattatttttttggtcctgccctcaatccctagccacgcacaatagccctcccaccagtccaaactatacaagggtctttctgaaaaataacctataagccgttttgccaaatgaattttcagaatggctttggctcatctaaagaagtggcttcacctcgtgagccagagccaaagccgtttttggagaagccagagccctgccaaaggggcccataataagccgtagaaccaaacaatcccgaagctcaccagctactcactctagagtcctgctcctgccacagtgccagttgcgcctcacgcagccacgcaggaataggataagcactatactacgcacgctctggcttccgcttcgtagatgcatgcgtgtcgccgccggaggctctcgccgcgcacgcgtcgcgcgctgcggtggtaacgacttcacggggtgtcccagcgtagcgtccgcgtcggcgcacacgcgccggcgcctgcccttgcggcgcaccgcccatcagctgctataaaagggcggcacaccgggtctgagtagtcgtcatcaacgacagccccagacaacactcaccgatagcaagtagcgccgccgacgtttcgagagcagagtatccaagctagccaagcgcgcacctcggtgacctagctagttcaggcgacgatatggcgtcaggtcaggaaagcaggaaggagctggaccgcaaggcccgcgagggcgagaccgtcgtccccggcgggaccggcggcaagagcgtcgaggcccaggagcacctcgccgaaggtatatatagccgactgcggctaaccatctgcatatgttaattcactgtcgttggctttaattacacgagtagtgtggctacctgatatgttctgaaatgttgcttgcacgtactgagtgattgcctctacgtttgcagggcgcagccgcggaggccagactcgcagggagcagctggggcagcaggggtacagcgagatggggaagaagggcggtctgagcaccacggacgagtccggcggcgagcgcgccgccagggagggcgtcagcatcgacgagtccaagttcaccaagtagtcctatcgcgtgcgtgcgtacgcagcgttcgtagctgtctgcgtagtgtaccttggccgtagctagtgctactctctactttggagtagctgaatgataataatgtagctagcagcatgcatgtaggcgatcatacatacgtacgtacacaggtacgtgtgtgtgatcatgtatgcttccagaagggtatcctagcttaatcagtcacgtcgtcaagtcgtcaatatggcaggttcgcgtcagggctttgtagtttgatagcctgtttcacgactcctcaataatcaagtagtgtaatgaaagtttggcggttccttgttattatctgcttgttgtatctcctgctctgcactagttaatttctcccatattgtggtagtaattatcatgtcgtcatcctcaacttttaggactagtttagttctggaggagaaccagagagattggagggcagggctagtggctttcaaactagcctttaacccttctcaattcttctaaacttttcttacgggccgtttggatcttcactcaataaaaattcatataattcatataagcctatattaaatttatggatttatggggatggggtgtaggataagaaatgatggtattagtagaatttatttctattctgtaacttctttttatagtaaagcatcttactaataatagtataaaaaatatcttatttagcttaattggtgacatttcacctcacttctttatattaaaaatgtagcacataaatatcatcggcatcctattaataatagtatacaaaaatatctcatttagcttaattgatatatgcctaatgtataataatagtataaaaaatattttgcataaaatgagattagcttaattgatatatgcctaaatacattagtacacacttcggcattttgctaataataatatacaaaaaaatattttgtataaaataagattagcttaatattgatatatgtctaaattattattattagaatgaaattcaattttaataatccaaacagggcgttaagggaatttttaaaattctggttgtcaaattttacctttcttgactatattttatggtaaaactacaattatagtcttagcatggcacgttctgctagcgggtacggttggtataaaggtcctgctagataaatcccgtgttatcccatagaacgggtagcaatctgccttgaatttaagccattcgtcttgaatcttagccgtcagatctactagctaggaaccacgtgatagcagagagattctgtcaacgttctctggataattttgccgttttgcgggacagagattc

SEQ ID NO: 678 - protein, 91 aa, Zea mays
MASGQESRKELDRKAREGETVVPGGTGGKSVEAQEHLAEGRSRGGQTRREQLGQQGYSEMGKKGGLSTTDESGGERAAREGVSIDESKFTK

SEQ ID NO: 679 - DNA, 7511 bp, Zea mays
gcatgcagcccagaggcaaagtggacgctttttagggttggtgccccccctcctcctctccaactactcacgcacttgtaccgtctcgttaaatgctgctggcctgccgctgcacatgaggaagcttttctcgccatgccagggtacggatcgtcgcccgtgcattgttgttgtggtagcagcacaacggaatgcggctgtaattcataaattctggcgaataaataccgtggcaggcccgctggatgtaagggcacggttaattgagtcacggtcatgtgcacaccagtaccgcgcgcgggtgtgtgtttgtgtttgtccctctgagatacagagtattctgcgcaccaaattagggtttgtttggacaatctcggattaaagtggattgaggtggtatggaacgtatcgaagtgtaatatgaactaatttctctttcaatccctccaatacacctcaattcacttcaatctctctttgcacaaacaaagccttagggatttaaaacaaccaaaagtgaggggaggggggacatagggcaacaaaattttatctgtatcagacaccttgcgatcaaggaaaaacaagctgatttagcaagtgtcagtgatcaagtaaaacaaggcaaattcgaaagtgtgaatatcaaacagtaccgttaggccgctgcctacgacttcctcgtctcagtgatgagaggctccacagtcgttgtcccttgcaaattgcaactgcaaagcgcggccctgcttgccggtaggaggagggtccccgccccggtttatagtaaccgcagcagcagcagcaggtttacgggcggagtgaagggaagccgcgccgcacccgcagtcactctcgccgtcgcagcacagcggcagggcagaagcggctgcccctgctgcgtttccgtccgtcgcccgcccgcccgcccggcgcccgcttctcttttgcccgcctctctctcttttgcatacgcctttcatctccaccccagtccccacccgcccgcaccgaggaaaaacttttttgaaaacaaaaaaccccccactcccacgtcccaccacctcgcctcggccgctgcgacagtgcatacgccccctcccctcctgactcctgttgcgtatacaccgtatgtgtctactgtgactccgggtcccgggggggtaagcgaccgagcaaggcttcgtctccggcggcggaggcggatctgggagggatggggaaccggataggcgggcggcgcaagtcgggggtggaggagcggttcacgcggccgcagggtctctacgaccacaaggacatcgaccagaagaagctgcgcaagctcatcctcgaggccaagctcgcgccctgctacccgggcgccgacgacgccgcgcccggcggaggggacctcgaggagtgccccatctgcttcctggtaagcacgcgcggggagatctccccccaccctcacgcacccccgatttcggcgtcggcggcgtcggcggcggcgccgtctgctgtggcgggaatgcccgaccacggtccacggttagagacctggactgaggggggaagatttcggcgggggggttactgggtccattggcgcctgactctgttggatttgcgtgtgccgttgccgcgattctgttactgactgggtggggggaggtcgacgaccgtgcacgcggttctagatgctgtgtgctctggaacctcctcctaggaccgtgggtttcagtacgcttagccacgtttctaggctaacagcacaattttgtcgactagttctgcaaagtgcagtcacggcggcgtcgtattttgtttgttctgtgcgcaggcgactgttaccttctgctctgcttctgtacgtgcattgttgttagggatattctaggggcttgttttaggaccagccgaacatttccgtgttttcaatgacttgagagtacttgactgttttgcctgataccccagagttgccaacaagtagtcaaaagcgcggtaacggtgggcatcattgttttttttttgttctgcgtatgtgtctgggatggtacctactgctcatgctctgctaggacatcatactgtatatgtacattgtgcaaaatgcgctaccatgttgtcctaagattgttatcacaccacatttgatgctttgatcatgttgtttggagaattttctgaattccttttggatggctaaccgctgtgctatatgaggttatgagtgccaccagtgccaccagtgccccattgattctaattcctggagcaacatggcttacgaatgttctactgttctactcctatgtgatggtagtgtggtaacaggcttgcacatcacttgaaatgggcgtattatacgagcctcgcaagaaactgctccagttccatgcctagttagctcagtaccagcgtattgggcacttctgtcttatggttgtatcgttacatcctttgtctaatcctcaatgtgaatctggttatgctcttgttatctgggatttttaatctcattgctattgcagtacacttaatgatttggttgcctgattggttgattctgttgtatggaattttgtttcttagatgttttcaatagctcgtggcgtttttttttccgcatctacatgtcttgttcagttgtttttagtgttactagttgggcaggacagcaagtactgcattttgatcactagcttcaaaagtacctcaggaatttggccaatgatagtgaagaataggatggtctatttggttcttagaagtattttggggttctggttagttggctgtttaactaatcagatagaatcatcagttgttttgtgcaagcactgtgttatctctccttgagcattttctaataagattgtttcaatttgttgcagtactacccaagcctcaaccgttcaaagtgttgctcaaaggggatatgtacaggtaatgcatgcatcctactgttgatttagccatcccacatctgcaaataacctttgcatatcctgtttggcatttttacagagtgttttcttcaaatgaaaccaactcatactgctcgacctacacagtgagtatcctttatttcatctcatcttagtttcatattatttggtgattacatgccttcttatgaaaaaaaaacttggtcgctgaaggtgcccattctgcaaaacgcctaattatgctgtggagtatcgtggtgtgaaaacaaaggaggaaaggagcatagagcagtttgtaagtcttagcctttaaatgcctgcatattccatttatgcattgccaacttctgtacagtctttagactgcaatctgcatttgctgtagcttatgtataacatattgcaggaagaacagaaagtcatagaagcacagttgaggatgcgccaaaaagaactccaagatgaagaagctaaaatgagaagaaaacagggcaggtgttcttctagcagaacggtaacaccaacaacagaagttgagtatcgagatatttgcagcacatccttttcaggttagcagtgggcataactaatatgctcatttaataatgctatctttctggtgtagtcttatcacttacacagccataatgtcattacctctgtagtgccatcatatcaatgtactgagcaaggaaatgaatgctgttcatctgaaccttcatgctctagccaggctaacaggcggcctttccattctagacacaaccggtatgttcatgctatctcttttatgtttcacatgaaaccattctatttttgtttgttgtaacttacaatttgcaacgtttaaatattacggaaacttgatcttttagttttacagtggattacatttaactgttgagatgaaatcgacatctaactactgtgccacctgtttttgctgacagtgatgataatgttgacatgaatctggagaacatgatggttatggaagcaatttggcgttccattcaggttagtggacaggaactagcaagatgcatgcagtacatgacttgaataatgctatgagtgctaatttatattggttttccaagagctgcacatagaccaacatttgcctaaaataaaactttaccagtttcagtgtgcaggatttgtagttaaagaaagcatggtgaagaccatgtgctctcttagaaagttacaacatctgtattttaaatagttatagcatatgtgctctcacttggaaaaaaaggattgtgtgctaacatgttgcatgttgataatcttttcacctgttgtgcaaatctcacatttgtttgttgtgctaacatgtgcatgtaatttgcagataagcatagtcatgctactgggtagtatagggtctatgagttctcctcgtccttcgcacttattcgctaaatagtcattgtcagcattagtatatccatttaacaaatactccctctgtttcaaaatatagttctttctagccttcttttttttatgttcacattcgaatggatgataatgaatgtcatacatacaaactacattcataggttaattaatgaacgcatgtttaatctaaaacgaaatatattttgaaacggagggagtagttcatattgaaatttagtcgttttctgtgatccagagttggatgttcatgttttcatttgccacggaatctcagctctatctgttttcggaatatcaagtagaattgattgaatttgttatggtgattgcacgagctaactttgcaactccagattgttagccaattatgtagatatcgaacatgatttgttatttgggtgctaatttagaggatagagtcactggcaaaatggttttgtggaatgaatgtagttaggtctgcgggataaaccaaaattttcttgcctgcaaccactacggataaaaaagcttctcgtatccataatgctggctaatacaaatatttgaggtaattagttttgagtactgccataatggggcaatatctaatatatgtatcaattatttgatatatgttatgaaatcttatggacgttcttgatactgcactatgggagtttgcttctgacaaaagtgccagatgtgcagacacttttggagcatgaattgacaactatgttttctttcatttcatttgaatagcctatttcaggatatttgaaggtcgagtagctaaactgaaactatagtggatatgctctgtttggtttaatgagttttgtgtacagttgtcctatttttataaagtcgatagtttctaaatattgcatcgtgttcccagttttgtgcttgttacttctcagtgcttgcatttgcatcctgcaaacgacaaccgaccattgacacccagctaacgtagaacacctgagggctggggtccagactcatcaagggcaaatgacactgctattacttatgaacaaccaatgcgtaaccatacatagtatcaactgatatgatctcaaggacttgtctgatcttagcaggcatctaagatgctcctaggcttcccattataatacttaaaaaatgcataaaggaaatgttttcataaaacagttaatggtaagattgatgagattcttcagaacaccttttgaaatcacttttttacttggatcaaatccgaacaataatttttgctttggaatttatgtatttgctaagtcaaagcaaactctatatctgtttcttatttgtttcattaccttagcaggaacaaggacatctagtaaatcctgtttgtggcagctactttcctgtaattgagccaccatcacgtgaaaggcaggcatttcttccggctgctcctctagaaatgcctcatccaggtggatactcttgtgttgcggctttggctgagcaccagccaccaagcatggatttctcttacatggctggcagtagcacatacccagtctttgacatgatccgccgaccgtgcaacatgtctagtggaagcttgtgcagcgtcgagaacagttcactagacacctggagcgggatggcaccaaattgcagcagaggagtggtaagagaggagggagagtgctcaaccgaccactggtcggagggtgcggaggcgggaacaagctatgccggatcggacatcatggtggatgcaggggccatgcaaccgctgcctttcgctgagaatttcaccatggctccaagccacttccgcccggagagcatcgaggagcagatgatgttttccatggccgtgtcactagcagaaggtcatcatggtaggacgcaagcgcaaggtctggcatggttgtaagttgtataacactaattttgacgccttgatccctgcccctttctgttggttcgacctgcttcccctgcacctctgcttttttgccactttgtttagctttttgctccttttttttcttttctttcttttttgcatgtgttgcttcatggcttgatatagatcttgctatagtcctccattgtcattgcttatatgtatgtaaaatggaatatgtggaaataggaaagaaaatgggtcgaaagttcttttgccggtaggatgcgcagtgtgttttcgcattgcaaagcattccaagattttgcaaagttgacctggaacaggcattctagctattctctccgttgacatgttcttggggtgtaaagatgtttgattctatgggaaaaaaacaactagactctggaccggctgaggttaatttcagacatgtttcgatctatttgtgaattcttctgatctgttgtagaactactttcagctgtagtgtatgacttgtcaggcagaggcaggcaacagcaacaccaatattatccagcctcacaagtatgtttttcttaaagggggctcaagtacaggtattttggcatggagcatgtcgatggaggatggacagactgaggacaatgtacagagatttgttgcgttgcacacgattccgcattccgaaccgtgaggttgacaaaaggagagaggatctcttcttggagaggaagcatcctgtttcttaacagcagttagcaggtgaggtgagaaaccttggatgccgacaccaatatgcaaagctggccggactgaaacacgggaattccaagttttgtcttattttccgcagaaacttacgcgaagcgaaggccaacaatggcttcaaatgcgttttgggggtaagaaatgaatgcagcttgtggcttgaaatgaggccatgagccaccgtgtgggaagggcaagggcttgcagttaggatggtagggcttgaaatggtaatgaattacgatctaaatatttttttcataatttatttaagcttttaattaattttagtttaaaaataaatagaaatagacctcggtcataattcgattcgatccttaaattttgtagtgtaaaatttagagctcattaccacctctatttgtagttgcacgtgtggacaactaggtgttgaaaattaggttcgggatctagctcggagcatcacaagtatctctaaaattaggttcgggatctagctcggagcatcacaagtatctctcccacatagc

SEQ ID NO: 680 - protein, 428 aa, Zea mays
MGNRIGGRRKSGVEERFTRPQGLYDHKDIDQKKLRKLILEAKLAPCYPGADDAAPGGGDLEECPICFLYYPSLNRSKCCSKGICTECFLQMKPTHTARPTQCPFCKTPNYAVEYRGVKTKEERSIEQFEEQKVIEAQLRMRQKELQDEEAKMRRKQGRCSSSRTVTPTTEVEYRDICSTSFSVPSYQCTEQGNECCSSEPSCSSQANRRPFHSRHNRDDNVDMNLENMMVMEAIWRSIQQEQGHLVNPVCGSYFPVIEPPSRERQAFLPAAPLEMPHPGGYSCVAALAEHQPPSMDFSYMAGSSTYPVFDMIRRPCNMSSGSLCSVENSSLDTWSGMAPNYSRGVVREEGECSTDHWSEGAEAGTSYAGSDIMVDAGAMQPLPFAENFTMAPSHFRPESIEEQMMFSMAVSLAEGHHGRTQAQGLAWL

SEQ ID NO: 681 - DNA, 6922 bp, Zea mays
gaaaagctctaaaagctataactcaaacaaacaagatcttagtctaggatattatttgggactgcttcacttagcgaaaacgaactcggcttcacaaaccactagccaaacagtaccaactttaaaattttcgcttcaccaaaaatgtgaagttacccctaacttcaccaaaaatcatgaattagctaaagggattcacgaatgagtaattttaactccctcttgaagttggggtaaaattgtccatctttgtcatcgattacacacctgcaagaaacgaaccattattttttctgttccctagctaccgtcgtcgtcttgttgtccggccgagccgcgccatggcgacgagtctcgaacagtgccgaccgaccggtggtgccacaacgtggtatagtgacggtcaccgtcgtcgcgtcagagagggtcgatgcgagcccctcgaactcgcggtagaggtggaggaatacgctgagcggcttgaagccgaggcggttcatggcccatagctgtggccatgctagccgcgtgcccgcctgcgaaattccgctactttaaagctaagctactctactttaaaacttacaacgctcagctgatttttgtgaagtagagcgatgccaattgccaaacaacgcctgagtaagtaatagcacgttagaaaagcaatctattgttgcaccacaagtccacatgtttagttgcaccacaagtttacgctcgtttgttgcctggcttgaacagtggccggagcccacaatgtttgtggtctagccggagagagaagggaagccgcgccgcactctctctcgcagtcgcagcacagcggcagtgcaggtgtgcagccgcagggcagaagctgctgcctgcccctgctgcgtccgtcgcgtgcagctgcagctgcagcgtgcggccccggcccgtcccgtccgcattgcctgcctttgcctttctctgcttcgtttcctccccaacaagtccccacccgtcccgcaccgagggaaaaaaaacttttttaaaaaaaaatcactcccacgtcgcctcgcccgctgcgacagcgcatacgccaccctcccgttgcgtacaccgtatgtatctacggtgactcggggggcacgcagacgcagtggggactggggagagcgagagcgaccgaccgaccgagcaagggtttcgtctccggcggctgcagcggagacggatctgggagggatggggaaccggataggcgggaggcggaagccgggtgtggaggagcggttcacgcggccgcaggggctctacgagcacaaggatatcgaccagaagaagctgcgcaagctgatcctcgaggccaagctcgcgccctgctacccgggcgccgacgacgccgcggccggtggaggggacctcgaccttgaggagtgtcccatctgcttcctggtaaacacgcgcggggagatctcccccttctctctcattctctcccgcaccccgcccccccccccccccccccccccccccccgcgggcgaattgcggctgcgtgcgcccgaccacgggcgacctggacggaggagggagcttcggcgcgggattactgggtcgattggcggttgattctgttggatttccgcgtgccactgccattgccacgattctgttactgggtggggaggtcgatgagcgtgcgtgcacgtggttctaaatgctgttctggaacctcctaggaccaggggtttcagtacacttagccacgtttctagcctaatagcacaatttgtcgactagttctgcaaagtgcagtcacggcggcgtcgtattcttgttctgtgcgcatgcgtcgttatcttgtgctcggcttcggtgtgtgtgtgcattgttgttagggatattctaggggctgtgtttccacaaggtcgtctgaggaccagccgaggtttagtacatttccatcttttcaatggctcgactgtttttgcctgataccccagagttgccaacaagtagtacaaagtgcagtgaaggtggcatcattttttggttctgtatatatgtctgcgatggtatctgctgctcatgctctaactaggacatcatactgcatatgtacattgtgcaaaatgcgctaccatgttgtcctaaaagattgttattacaccacattttatgctttggccatgttgtttggataattttcttggatggctaactgctgtgctatgaggttgagtgccaatgtcccattgattttaattcctggagcaacatggcttaagactattctacaattttatactcctacctgatggtaatgtagtaacaggcttgcatttcttgaaatgggcagtggtacttctagatgctcctgggatgggtgtattatacgagtcttgcaagaaactgctctggttccatacctaataattatctctgtaccaatgtattgggcacttctgtcttttggttgtatcattgcatcgcttgtctcgtcctcaatgtgaatgtggttatgctcttgttaactgggatttttaatctcattgctactgtagtacttagtgatttgattttgcctggttggctgattctgttgtatggaaatatgttcttagatgttttcggtagctcataaaaaatagaaatggtgttgattttgtttgcatttacatggcttggtcaattgcttttggtgttactatagttgggcaggtactccaactctgttgcattttgatcactagcttcagaagtacttgaggaatttggtcaatggtagtgaagaatatggtggtctattttgttcttagaagtattttgtcatttggttagttggctgttcaactaaccagatataaacatcagttgctttgtgcaacaccatattatttttctgagtcatttcctaataagattgttttcatctgttgtagtactacccaagcctcaaccgttcaaagtgttgctcaaaggggatatgtacaggtaatgcatccattgtactgttgatttagccatcccaacctgcaaataacctttgcatattctgtttgacattttttacagagtgttttcttcaaatgaaaccgactcatactgctcggcctacacagtgagtatcctttatgtcatcttgtcgtaatttcatactgtttggtgatttatacaagccttcttatgaaaaaaattgatcactgaaggtgcccattctgcaaaacggccaattatgctgtggagtatcgtggcgtcaaaacaaaggaggaaaggagcatagagcagtttgtaagtcttatcttttaaatgcctgcatcttccatttatgcatgtccagcttctatgcagtctttagactgcaatctgtatttgctgtagcttatgcataacatattgcaggaagaacagaaagtcatagaagcacaattgaggatgcgccaaaaagaactccaagatgaagaggctaaaatgaaaagaaaacagagcaggtgttcttctagcagaacagtaaccccaacaacagaagttgagtatcgagatatttgcagcacatccttttcaggttagctggatgtaactaatatgctcacttaataatgctatctttcttcgttgtagttttataacttacacaattgtaatgccttgatctctgtagtgccatcatatcaatgtactgaacaaggaaatgaatgctgttcatctgaaccttcatgctctagccaggctaacatgcggcctttccattctaggcacaaccggtatgttcatgatctctttgatgtttcacatgaaacctttcgatttttgtttgttggtgaaatcggcatctaacaattgtgccacatatttttttgacagtgatgataatgttgacatgaatctggaggatatgatggttatggaagcaatttggcgttccattcaggttagtggacaggaactattttgcaagatgtgtgcagttcatgacttgaataatactatgaatgctgatttatattggttttccaagagctgcacatagaccatcatttttctaaaataaaagtttactggtttcaacatgcagcatttgttgttaaagaaagcatggtgaaagctatatgttctcttagaaagttacagcatttgtattttaaatagttatatggcctctcttaggggaaaaaagattgtgtgataacatgttgcatgttgataaacttttgacctgtcgttcaaatcccacatttatttgttgtaatgctaacatgtgcaagccatttgcagaaagcataatcgtgctactgtatggggtctatgagtttttccttgcccttctcatttctttgggtaaatagtccttatcaacattagtatattcatttagcaaatacgtagtccatattaacctttagtgttttctgtgatccagaatttggttgttcatgtttttatttgatatgaaatctcagctctatctgtgtactgaatatcaagttgaattggtcgaatttgttatggcgattgcatgagctaaccttttgcaactccaaattattagccaattccattccttaaaagtgaaagggcctctagcgtaatggttaaggcttccgagtagcatctctaggtccgggttcgatcatcctcggggacgaatttcaggcttggttaaaaaaatcccctcgatgtgctctgcctgctcccgggttacgtcctacgcgccaccctccggctgtgccgttgcaaagtgggcggtgacggcccgctagtgatgggatgctagggttcggagattttcttggccgggaccatgtttcggtctcttaatataataccgagagggcgtctttccctctccggccgaacaataatcttggctttgtttttttttttgtatttgctaagtcaaagcaaactcttatatgtatctttaccttagcaggaacaagggcatctagtaaatcctgtctgtggcagctactttcctgtaatcgagccaccatcacgtgagaggcaggcatttgttccggctgctcctctagaaatgcctcatccaggtggatattcgtgtgcagttgcggctttggctgagcaccaggcaccaagcatggatttctcttacatgagtggcagtagcacatacccagtctttgacatgatccgacggccatgcaacatgtccagtggaagcctgtgcggcgccgagaacagttcactggacacctggagcgggatagcgccaagttgcagcagggaagtggtaagagacgagggagagtgctcggccgaccactggtcggagggcgcggaggcaggaacaagctacgccggatcggacatcatggcggatgcaggggccatgcagccgctgcctttcgccgagaacttcgccatgggtccaagccacttccgcccggagagcgtcgaggagcagatgatgttttccatggccgtgtcactggcagaagctcatcacggtaggacgcaggcgcaagggctggcatggttgtaagttgtaacactaattttgacgcttcggtgcccccctgcccccttcctgttgcgctgccgttccacttgccccgccccgcttctctgttttttattatttttttggtgccaccttgtttggcattttgctcttttctttctttctctttttttttttgcatgtgttgcttcatggcttgatatagatcttgctatagccctccattgccattgcttatatgtatgtaaaatggaatatgtggaaataggaaagaaaatgggtcagagttcttttgccggtagaggatggggcagtgtgtttttttcgcatcgcagagcattcttaatatcttgcaagtttgcattgtaaccattctcttccgttgacgtgttcttgggtcctgtaaagatgcttgtctgtatggggaaaaaaatgttctagactcggccgatcgaggctgtttttcagacatgtttcgatctacttgtgaattcttcttatatcttgtagaactggttccagctgcagtatgacttgtcaggaagagccaggcaactagggctggataacgagtcggcttgtccgagttcgagctcggttcggctcgttaagttaacgagccatagagtgagctcggctcgtttacgagcttgagctagctcgtttagctcgagatctagagcagaaaaaaaataatatgtatataataattatttttagttaattttaaactaatttaacaatagaaaatagtaattatattcataatttcacaaaccacgttaatgtaacaccaaattagcacaactcatcaattcatataaatgttcatcagtttaacctacaattatatttgcatagaccaatttaacatatagacatagttcattaattattagtttaactcattgtcatagacacctcatacatataacatgttcatcaattatttcgtaaatgatatgtgtatagtttcgtttcgcggggatgtggtagctcgtttagctcgtgagctggctcgttaacgaactaaaccgactcgttaacgaaccgagctaagatgaaaacttagctcatgaaaaaatttaagcgagccgatccgaaccgagccgagcttaccataagccgagcgagtcacgattattttgtccgatcctcacagcaacaccaatattatccagccgtaccgcaagtgcagatttttttccctagagctcaaggacaggtatattggcaaagcatgttggaaccggtggacagactgaggacagtggattgttgcacacgattctggggattcgaagccgtgaggttgacaaaaggaggaggctcccttggttggagaggaagcatccattccagctgccacggttccttgcaagaaggcgagagacctcggatgccgacaccaatcagcaaagctgtccggactgaaacgcgggagttccaaatttggtgcgaatttcgtacg

SEQ ID NO: 682 - protein, 430 aa, Zea mays
MGNRIGGRRKSGVEERFTRPHGLYEHKDIDQKKLRKLILEAKLAPCYPGADDAAAGGGDLDLEECPICFLYYPSLNRSKCCSKGICTECFLQMKPTHTARPTQCPFCKTPNYAVEYRGVKTKEERSIEQFEEQKVIEAQLRMRQKELQDEEAKMKRKQSRCSSSRTVTPTTEVEYRDICSTSFSVPSYQCTEQGNECCSSEPSCSSQANMRPFHSRHNRDDNVDMNLEDMMVMEAIWRSIQEQGHLVNPVCGSYFPVIEPPSRERQAFVPAAPLEMPHPGGYSCAVAALAEHQAPSMDFSYMSGSSTYPVFDMIRRPCNMSSGSLCGAENSSLDTWSGIAPSCSREVVRDEGECSADHWSEGAEAGTSYAGSDIMADAGAMQPLPFAENFAMGPSHFRPESVEEQMMFSMAVSLAEAHHGRTQAQGLAWL

SEQ ID NO: 683 - DNA, 5354 bp, Zea mays
taaaaattaaaaaatgtctctaatatatgtatttgagtatagatgacgtgatttagagaacgttgttggaaaggaaggatatatagaggatgaaatcttttagagtagattgtaaatgacggatatagagaatgaatatagaagacgttgctgaagagtgaagacaatctgaaatctgagaacatagattcccgtggccgtaggagtcaagagtcagagtcagatatggtggctgcctggctggtgggttgctgaacgcaccagcaagcgttgcgtccatcgtccatgcagagaacgaaagcacagtgggcaacttccagctgtgggatagaagatccctggcccccggaagatacctcgaatcttcagtcccattggtaggtccgtatgcgcggtaaaaaaaaagatggtgccgatgagatggcttccagcaggagcataattgaatccaaaaacaacttttaaaatcgaattgctgttatccgcagacatcggaaaagcttccaaatttccttcttttttttggcacccccctacgctcggaactcatatatcaaatcaaccacttctcgcgataaagctgcaccgccgaattcaacattttcccacgccaaccgctccacgcccccgagtccacatgtaactgacaggtgggcctctctaataggcaggtcccggatgtcagaagcaggagctggacgctttccctgtacgcgctggtcccccttttgtcgcacctaccgcgtcgaggaaataagccgaatatattatgcgcggaactcggaaggtgtaaccgtgtaacccggttgccgtggttgtaatcgtacgtgtaaagcgtacgcctacgtatttttactgcgatcaagggcgagccggctggacgccaacttgtttcgtatccctcggtcgtcgccaatatatatagccgccctcctcccggccgatcccttcgtcctcaatctcaatcccacaccaccaccaccacctcctccggtccccaacccctgtcgcaccgcagccgccggccatggcctgcctcaccgacctcgtcaacctcaacctctcggacaacaccgagaagatcatcgcggaatacatatggtacggcgcgcgtttccctgttaatctgcatgctctctctctctatctatctctctctctctgcctcactagtcagaaaaaagaatcgatcttgctcggtgcccccagccgccttctcatggcgtctccccgtcgaacaacgggatttgggatttggtgatgaggggggtctctgtttttttatttatttcggtgatcgagtggactttatttgtttgttctccagttttaaaaaaaaaaatctgctattttggctcgattattcgcccatgaatatttggcttcagtttaggatatgcttcaagagacggacagatgcagccctgtgcccctgtacctcttgtttgtcctgctgctgctgcggcagtctgtggccctgtgctcaccggccaccgcgccgcttatatggtgttattactgtaccactggccaccgccagatgacctgttggctaaaagacctaatcgcacgtcttacctcttacgcgttaattgacccccccccccccccttgtgctagtattagtacaccaaagatgcatgattttgttgttagaaacacgtcttggagtgctctgctccgaggaatatggtggccagtttgttctgttcagtttgttgttggcgatttgatcctatattaatgcatgccttttcgggtggttttcaggatcggtggatctggcatggatctcaggagcaaagcaagggtaagataagattcccagcactagtaggaggaccttgggatacttatcacttatatatctctgaagtcgtcatccgctgagctggtctttggcttatataccagagctctgctcaccactaccactgcaaacgatttatttttttcttctatttcgtaaaaaataaaaaattcatactgatctggtggttgttggtggtgcatggtgctggtgcagaccctctccggcccggtgaccgatcccagcaagctgcccaagtggaactacgacggctccagcacgggccaggcccccggcgaggacagcgaggtcatcctgtagtaagtgtcatggcatgccaagcttggatgcgttcttttgtttgttttgttttgttttgttttactagcaaacatgggaacgatccttatctcttgggcatgtggcaccctgcagcccgcaggccatcttcaaggacccattcaggaggggcaacaacatccttgtaagtgtatacttgtaccatccaagtggcatgaaccatacggttccgtgttatctactgctactgttcattggtccacctcagatcagtttatctttgtgaagaagggaggaaaaaaaacgtgtcttgtttcaccaagtaaactaaaatccctataaatctccctttttaatatgcctgatgcataggctgaagtatcttgatgcagcactagtggttcctgatgcaaatcctttaccctgaacctttgttcaggtatatgcaataacgcgaattttataacacgatgacattggttgctatgagcttgtatagatatttttttttgtagttaggtgtgatcacccagtgtaccaaacccaaggtttaggaatccaacaattggtccttccctctcagcttgtctaacagtagggaccagttttaaggtgctgaacagtgaactggtttgacccacaggtgatgtgcgattgctacaccccagccggcgagccaatccccaccaacaagaggtacaacgccgccaagatcttcagcagccctgaggtcgccgccgaggagccgtggtatgcaaatctctctcccctcccctcccttcccttccccccggtatatgtggcgtaaagctgaaacgatctacatctactacccctgactgactgactgaccatgatttgatttgttctttgcaaataaatggcaggtatggtattgagcaggagtacaccctcctccagaaggacaccaactggccccttgggtggcccatcggtggcttccccggccctcaggtacacatgacatgatcaccgcttgcgcttcacggatgaatttgcttgcttgcttgccgaagacaccaccggttcgatgacaaagtacgccgttcgctctccgtgtttttagggtccttactactgtggaatcggcgccgaaaagtcgttcggccgcgacatcgtggacgcccactacaaggcctgcttgtatgcgggcatcaacatcagtggcatcaacggggaggtgatgccagggcaggtgagagtgtgagacgctgctgctgacagcttcttctgtatccctgaatctaccatttttctgaccatggcgaaacactggttggttggttggttggttggtttcagtgggagttccaagtcgggccttccgtgggtatttcttcaggcgaccaggtctgggtcgctcgctacattcttgaggtatggttggttgaccatgtatgtatgtaatttatgtaacgaaaacgaagcatggacaatgatgcggtaacctgtgctcccttttgtttgtttgtttgtttttttacagaggatcacggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacagggagcacatcgcggcctacggcgagggcaacgagcgccggctcaccggcaggcacgagaccgccgacatcaacacgttcagctgggtacgtacgtgtcttgtccctccccctggagcctggaatctcggctccgagaacctgcgcccaactgatggatgttatgcgctgcgcttgtggcggtgcagggcgtggccaaccgcggcgcgtcggtgcgcgtgggccgggagacggagcagaacggcaagggctacttcgaggaccgccgcccggcgtccaacatggacccctacgtggtcacctccatgatcgccgagaccaccatcatctggaagccctgagcgccgcggccgttgcgttgcagggtccccgaagcgattgcaaagccattgttccttccgttccgtttgcttattattgttattatctagctagatcatctgggggtcaggtcgtcgtggtgtgccaaaacagaacacagaaagaggaagaagaaaaaaaaaacaagacgtgtggcgtttatgttatatcatccaataatggccgtaccacacttgtggtacctttcagtacgtatgcttgcattgtatgaggggtcgctttcctacgccctaccatgtctgtggctttccttgcttggtgatgcgatatggagggaatcgttcgtcagtgccagtgggcggcagcattattgtcatcgtcgcccgattggatgaataaactattattagcctgttttaggtcagaagatctgtcgtctttccccccgggaaaaatcacggtcgacgaacctatcactcttgatcggttgaggtgtcactcgcgatagcttggctgcttagcacaggagcgagggaagtggagagcaagcgaatccatcacgaggccttggaccaataatttctcccagagcaggacgaactgtaggagctggaaattcttctgatcggatcatctgctccaactgcaggtacgtatgatatcttgcatgctctgttctttaccgtgtcaccaacccactacacctattgcgaccattattccacctatacggccaacaaactatataccgagtaaaacgctatacagtgatttacacagagagcagagcaggtaaccatttaatctatttaataaatgttcaagctaaccccgatcgcgacagagggattgggttggccattgctttcttgacgttttattgacatcgttgacatgcacggcaccttcaccaacccccccgcgacgttgcacaggctgctcaacgcaactactcgccttgattgggcgacgccgtctgttcaagccaaaggctggcgacccacaatggtacactagactacgggggtgcttcaagagaccaaaaataaaaataaagaaaatgcaatcggcaatggaaattactacaagagagtttatatccataaattaaaaaaatactactggatatttagcttttgctcttaaggagatgagttacagcttcttttttgaaattaaacttgactggctccaagctaaatagttgctaaaggttctctcgatgatacaaagaggaaggctcatgaatag

SEQ ID NO: 684 - protein, 356 aa, Zea mays
MACLTDLVNLNLSDNTEKIIAEYIWIGGSGMDLRSKARTLSGPVTDPSKLPKWNYDGSSTGQAPGEDSEVILYPQAIFKDPFRRGNNILVMCDCYTPAGEPIPTNKRYNAAKIFSSPEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHREHIAAYGEGNERRLTGRHETADINTFSWGVANRGASVRVGRETEQNGKGYFEDRRPASNMDPYVVTSMIAETTIIWKP

SEQ ID NO: 685 - DNA, 5132 bp, Zea mays
tatatatttaatatagtataattataaagctaattttttagagacgaagactggagatgaagactaaaagacgggacataattattaaacctaattaattaaacatctatataatactcgtaattgatattcaaacgtttaatatgacgtgaactaaattttttagtaaggtaagtatttacagtacatgaatagttttagtttgtactgccaaattgtatatggcagtgggagtcactattctcatatatggtatatggtggctggtgggttgctgaatgcaatgcaccgttcgcccatcgctacgctacatgcagagaaccatcaataaagcagtgtgcggcttccagctggagtagaagatccctggcctcaggaagatacctcgaacctccagccccattcgtatgtccgtacgtatacagtaaaaatcattttgcagctggtgccgttgagatgggcatgggcttaggtaggagcacgattgaataaaaaagattttattaaaaatcatttactactccttttgggactatccccagacatcggaaaagcgtccaattttctttctttttttcaccccctatgctcggaactcataaatcaaatcaaccacttctagcgataaagctgcccccgccaattcaatatttcccccacgccgatctctccacgtccgagtccacgtttaactggcagtgggcctctaacaggctcgtcccgcatgtcagatgcaggggcttgacgccttaccagtacgcggtgctccctcttctcgcacctaccgcacggaggatatgacctaatacaattaatttacgcggaactcgaaatgtatccgtatttatacgtgtggaacgtacaagtatacgtattttgttggttttttttttactttttacccggctggacgccaaccaactggtttcccgtccttggtcgtcgccattatatagccgccctcctcccgggccgatctcttcgtctcaatcccacgccacatcctcccctccttcctccttgggttcccagcccgtgcgcccgcctgtcgcagtcgcaccgcagccgccggccatggcctgcctcaccgacctcgtcaacctcaacctctcggacaccacagagaagatcatcgccgagtacatatggtacggcgctcgtttccgtcggccgccctctcatggcgtttcccccgtccgggaacggggttgggagaggggctctggctctgtttttttttcctgatcaagtggcttcatctgttcattttccgagtaaaaatctgttatatttgctcgcttattcgcccatgaatatctaacctgagtatcgggtaattccctgcccacgggtccctcaccggccaccgcgccgcttatacggtgttgtcgctggccaccgccagatgatctgttggctgaaagacctaatcggatgtcttacacgttaattgatccccccctgatgccagtattagttcccaaaagaagcaagtttttttttgttgttaattgttataataaacacgtctttggattgctctgctccgaggaatatggcgaggagttgttcggtttgtcgtcgacatgatttgatcctatcttaacgcgtgccttttttggggtgcaggatcggtggatctggcatggatctcaggagcaaagccagggtaagataacagattcccagcactgggaggaccccccgggatactggtggttgtgactcgtcgtcacctatcacttatccctgagctcatccgctgatctgttatttggcttatacatacatcagagctctgctcaccactatcactgcaattatttttgtttctctgttctacttcgtagtaaaatcatactgatctggttggttctggtgcagaccctcccgggcccggtgaccgatcccagcaagctgcccaagtggaactacgacggctccagcaccggccaggcccccggcgaggacagcgaggtcatcctgtagtaagtgtcatggcacgccaggcttggacgcattcctttctgtttgctttactgaacgatcctttctcttgggcatgtgctgcagcccgcaggccatcttcaaggacccattcaggaggggcaacaacatccttgtaagtttgcacttctaccatccaagtggcatgaaccatacggttccgtgttatttactgctacagtgcctactgttcattggtccaactcagatcagttcatctttgcgaagaaaaaagaattgtgtcttgttgcaccaagtagactaaaagttgtacataccctacaaataaattagatttttttttaaatctgcctgaactatcttgacgcagcaccagtggttcctgacgcaaattgttttaccctgaacctttgttcaagtatatgcaatattgcgaattttataacgcgggtgacattgttgttatgagcgtatatagatattttgttttttgtagctaggtgtgatcactcagtgtaccaaaccatggtttaggaatccaattgtctaatagtagtaggggccgcatttaggtgttgattgaactggtttgacccgcaggtcatgtgcgattgctacaccccagctggcgagccaattcccaccaacaagaggtacagcgccgccaagatcttcagcagccttgaggtcgctgccgaggagccctggtacgcgaatctctctcccctccacctccaccgatatctgtgatgaaaggctgaaacgatctatctctgacgatgcttgtttcttgcaaataaatgacaggtatggtatcgagcaggagtacaccctccttcagaaggacaccaactggcccctcgggtggcctattggcggcttccctggccctcaggtacattcactaatttgcttgcttaaggcttcttctgtcgaagtttgaagtttcacctaaatgacgtccactgttccgtgcttagggtccttactactgtggaatcggcgcggagaaatcgttcgggcgtgacatagtcgacgcccactacaaggcctgcctgtacgcaggcatcaacatcagtggcatcaacggggaggtcatgccggggcaggtgagcagcgcgcggctagacctggcaaaaaccttgttctgtatcagcttccgtctttgttgaccatggcgttgcggctgggttggtttcagtgggagttccaggtcggaccgtccgtcggcatctcttcgggcgatcaggtgtgggttgctcgctacattcttgaggtacgacgccacgtctttctctgggctagaacatttgtaggacgacgccgtctcgtcttgtcttgtccaagcatgtgtgatttgtgcgctgcattttttttttgtttacagaggatcaccgagatcgccggcgtggtggtgacgttcgacccgaagccgatcccgggcgactggaacggcgcgggcgcccacaccaactacagcaccgagtccatgaggaaggagggcgggtacgaggtgatcaaggcggccatcgagaagctgaagctgcggcacaaggagcacatcgcggcctacggcgagggcaacgagcgccggctcaccggcaggcacgagaccgccgacatcaacaccttcagctgggtacgcttctaattgtgcaactgctgtaccgtggaggatcggcgaaacccgtgtgcctgccaactgttgttgctttgtgccgttgcagggagtcgccaaccgtggcgcgtcggtgcgcgtgggccgcgagacggagcagaacggcaagggctacttcgaggaccgccggccggcgtccaacatggacccctacgtggtcacctccatgatcgccgagaccaccatcgtctggaagccctgaggcaccccgtggccgtgtcgtgtcggtttgctccgcgtacggcgctggccgttgcatcgcagggcccagcggttgcgcaactattttcccttccccgttctgtttgcttgtactactactctaccgctagtcctgcatagcattttagctagaacacaacaacagccaaaaaaaagtattgttgcttgcttcgacgcttgccaccacttccattccatgccgtccgtccgcttccttcctgtgtaatcctcctccaataatagacgtgccatgttgcatcctctattcctctgcattgtataaaagtggtgtaattcttttgctacgcctccaatgtctgtggcttttagctgctgatgcgatgtcagattctgtcacggacgattcgtttcttttccttccgataattcagcgccgccggtcatctgacactgacatgttcttccgtcgacgagctggcggattactgttcatcggttgcggtgtcacgcgacgcgacagcttaatgattggttgttaccgtggcgtacatgttgctgcagctacagcagccatcaagcgccccctcggccctctctcaggtggtcgattggtcggatcagactgtctggtcgtcgaatagttccccgtgttcattcgtctgatcggatcatctggttggaaagcagggacccgcaacacgagcatgctaccgtctcgtccaagctctcgctatatattcacgaacccaattattactactgcggcagaggagaggatgggcattgctttcttggcgttggttcacatcgttgacctggcgaccacggcgccttcaccaactccggcgacattactgcacgggtacaaccaaaccactactctcgccttggatggcggcggcgtcgtcttctcttctctccgatctggtcggtcaaagcctgacagcggccggcccaggccaaccatcaccgagaggcaaattgaaagcattctcaatccagccagtgtaggaaacgtccgtcctggggcggacgtacgggacggcggggagcctcctagccagacacggacggggcggcggcgactaggcaaacatgtcgctccatcctcgccggctccggagtggccgattacaggaatagctggtggaaagacgataataggatacctaaatatttgctgctgatggaagcaaagcttgtctgctggccgtgtgtggcatcggcaagaaagatgggtattgtttatcatgatggtgctgattcggaatcctggctagatgtcatatttgcgtacgaaaca

SEQ ID NO: 686 - protein, 356 aa, Zea mays
MACLTDLVNLNLSDTTEKIIAEYIWIGGSGMDLRSKARTLPGPVTDPSKLPKWNYDGSSTGQAPGEDSEVILYPQAIFKDPFRRGNNILVMCDCYTPAGEPIPTNKRYSAAKIFSSLEVAAEEPWYGIEQEYTLLQKDTNWPLGWPIGGFPGPQGPYYCGIGAEKSFGRDIVDAHYKACLYAGINISGINGEVMPGQWEFQVGPSVGISSGDQVWVARYILERITEIAGVVVTFDPKPIPGDWNGAGAHTNYSTESMRKEGGYEVIKAAIEKLKLRHKEHIAAYGEGNERRLTGRHETADINTFSWGVANRGASVRVGRETEQNGKGYFEDRRPASNMDPYVVTSMIAETTIVWKP

SEQ ID NO: 687 - DNA, 11222 bp, Zea mays
ggttttattgatgcctgactttagcaatcactctatattttgatctatctttttttataagtttgactttatgagacttatttttagaaacttgagctcacaaattttgtcttatttggtctctgtatgatggaattatgtcattttataatctctgttcattcatcagtcattgtgaacttgtgaactctttctaatcgctcacttcattggtcgtgttgtaccaagacatattgcatggagtaaacaataacatcaattagccaaatcaaaaaaatattataaagagagtggagacaatcaataaaaaatcttgaatttttttaatgaatagtttacgtaggtattattgtaagccgtcgcaacgcacgggcaaccgactagtataatttaaaggatgagttcatgcttacgtctagactagttggatcgacaagtcgcctcacatgctgacaacaagttaaactaactttttaaactcactaaagaagcgggctaggctaaactaacctcgactcgtcacttgatcgaaagcgagagacgactcggactcgttcccaccctcgcgagtcgcgaccagctcaaaatcaactagcggccggacggcagcggcggcgcactcccgttcgggtccggcggaatccacctcatcacgtgaacttggcagaatctccgtgcgcgcgcggtccaagattctgaccgccccgctcctaaacccacgttgtgtgtaccccccaccttcacccaatggcgaggggcccccacatatattagagccccacacatcagtggctctggacagcccgtacaagcaaaagcaccagccgcctagtggtgggagcgccaatagagccgccaactacacattcgacggccgagatgccgtgattacctgcgaagccctaattaaatcaccattccctgcctaaaactcccatttcgccgtccgtgacgcgagagacctcttcgcatcccgaggcggcgcttttggggtcggaagcgacacgggcgccgggcgggtccgcgggtggtggtgctactgctagcaagcagcagcaggcgacgctaggcgagagccccagtcggagcaggccaccatgtgcggcatcctcgctgtcctcggcgtcgctgaggtctccctcgccaagcgctcccgcatcattgagctctcgcgcaggtatggcgcggcaccccaccgtccgtcttgccgtcccatatccatctgtgccttttatgtggcttaacgcggccccgcccccgccctgctatcgggtgggttgttggcgtattgcggccgtctgaggagagggcggaggaaatttggtgtcgggttgggatagtacaacacctttgggcaaacgggatatctctagtttatctaaccctctgtagtccgcttgtcgtttcaatttatattaacatctgaaaaggaccaccgatatgtggccaacttttgcaaaacatagtatttgtctccgagaatttgggaatgagctatgatgattgatgaatggtagatgtctatttttttttccgagggcccatgtagcgcgacatggtgtgtctatgtcgtgagagaaattggcaggaccagattttcaaaatgcaaactggtatctgcctatatagatggatttttgtggggttacagtttaagtgtttgcttcaagtttgaaatgaatacgtgtttttcatgaatagtaatgactgtatacatgtacatttcatctgcagaatggctttaaatgtaaattatttgaatttgagtaaaatgtagcatgtatagaactatagatacacttgtatggtgtttggtttgagaaataagttagtccatcatcttctcactcctcacttttttgtttggtttgtggaatgaaatgagttgatccatcaccacctcatttctcatagttagttagttagtactaatatgaggaatgaggtttccaccaaatttgaggaatggacttatgatgcaccaccttgaatgaagtgattcctcaaaccaaacaccccttgatgttcagcaacaatcttctagggtttatctgctagtgcttgtggtggcaagtgtggaggttttggttcacggttcctcttgtggagattatgatttcaaacacaaaacttgctccttccagttgcaaattaaaatattgcaaaacttgcatacataaattacaaatttagattatataactgggtcacctaaaattatctttgtcaatgatttatatgactcatttagcaaaccagaagaggagtaaaagagaaaaaaaagttgcctagaagtgtcacagtggcctatgattagagaaaaactgagaagcagcagtttttataatttatagaagcaattaatgttcagttgcgcactattgtggagttactgacttaatcttctagtagagtaaataggtgttgattgtagacatcttattgaaatctgaaatgagaactatatgtctcttgacttcaattagtataatttctttgtgcttttttttgtgacagaccgttcttaagaattacagggtgcttgttataaatttgttatacacatgcaccccactgaaatgaagttcatattttgttaggttacggcaccgagggcctgattggagtggtttgcactgtcatgaggattgttaccttgcacaccagcggttggctattatcgatcctacatctggagaccagcctttgtacaatgaggataaaacagttgttgtaacggtctgtatctggattagaaataattttactgtatccactcatttttttatgctaactgtagagtttgcaacaaatttgtttaattgttctgcttttggtaaatgtcatttgtttcaaaagtctgtaatgcccataaatagcgatctaagaaatcaatcaaacaatcccaataccatgaattagaaacttcccagaccctgggaggattagcgaatgcccttaatgagctgagtgtgacttaatgtgctatgatatgaacccaccagaagtcttgctttaactaaatgaactagaggaaatatggttctatttgtgtatagttatttcaccatttttatcttctggttgtcatttccaggtgaacggagagatctataaccatgaagaattgaaagctaagttgaaaactcatgagttccaaactggcagtgattgtgaagttatagcccatcttgtaagttgcatatttatacccttttaacagtgacataacttttgccaacgatttcattatctccatcgaagcatcagcctctcttataaagttatttaatgttggcattgagaccttttaatctctttaatatttctttacacagtacgaagaatatggcgaagaatttgtggatatgttggatggaatgttctcctttgttcttcttgatacacgtgataaaagcttcatcgcagctcgtgatgctattggcatctgccctttatacatgggatggggtcttgatggtatgtaaaccaaagctgattgctttgtccctctgaagaaaatcatgcatgaattatgtttttgattcatttcacaaaacagaacttctaggatcagtttcataaaacttgcatccatttcaaaacttgcaacgatttgcatgggcccactatttgcgttgttttttgattcacttcacaaaacagaacttctaggatcagtttcataaaacttgcatccatttcaaaacttgcaacgatttgcatgggcccactatttgcgttgctggaaggtgggtccaatgaaggtttgtggaactgagggcacaaatagttgtaccatgaaacggatcctagcaggaactggccagttaccgcgaagaacctcctggcatgtagcatgttctctaggtcctggaatagagaaaccacacaaaaaacacttaaatttaaatttgcatgctgatctcttaatgaaacgaaatatagaaacaccagtagctgtccatttctgcagtacattgaaaaaggcaacagactgggaaatattcttgatctcaacaactggaattcaggttgtctgatgggacagttttaattgctgttatgcattagtacttgcaagctcttaggtaatgatgacttatgtgcacattgttgttcatgctagtatgagcgtagtttcttcatgcaattaagatgtcatattgactcttttggaggttctggttttgattaccagtctggcagcaggatgttcctgaatctgatatagaaccatgttaaaagttcattctgctgtccaaaagcaaaaaccgaaaaaggactatattatgttatttagggggctatgtacttatttggataagtgttcattccgctgatatttgatactccctccatcccaaattataagatgttttggtttttgtagatacatagctcttgccatttacatggagtcttggacatacactatgtctagatacataattaaaacgatatatctgtaaaagccaaacattttataatttggaacatagggagtatatctcgaactattattatttcttctttttcccaatcttgagaaataggcagtgtggtgtagcccccaactcaattcgtcactatatgtcttttctggattcagattagctgctacttgagattaattcatagtgtgctacgttatcaggatcagtctggttttcttcagagatgaaggcattgagtgatgattgtgaacgcttcataacatttcccccagggcatctctactccagcaagacaggttgacatatctagaagactatctcctatctcatcccacccataatccagaatagagttttcagatcctggagcaaaagtgcaatctaagccactacttatgtttcaaatttccttttgttttgccttctaacctgcttttttatccttcctaggtggtctaaggagatggtacaacccaccatggttttcagagacggtcccttcaaccccttacaatgctctcttcctccgggagatgtttgagaaggcatgtttccttcctgataccatgcactactttcatacttgttgatacctatctgttcactcatctttctctctctctgttttgttttacatcttttgacacatagttataatgcatttgatatatttatgtatgccatatttgctattagggtaactatttgaatgttgttccatcatttcatgcttatattatatgttaatgactttgattaagtaatgcctaattgcctatccgtaaacccgtcccacatggggtcttcgattccgacctctacgagccgtccgtaaaggtcaaacagacggagggggatcaggacaagaaggatgacggccaagctgcccctgcggcctagactcgcgagctggtcgcaacaaccgatcgataggattggcgccagccctcatcgatcgattatcggacgcagctctgctcgaagacgtgaccgaggccaggcggctctctctcaaggcgaaatccttcatgcttatcgacgggacgctctataaaaaaagcgccttcgggattaagcattagtgtattacactcgaggagggacaacaactgctcgctgaggtgcacggaggaacatgcgggcaccacgcggccccacgatcgcttgacagcaaggcgttcaagcaaggcttctattggcccacggccatggccaacgccgaacaggtcgtccgtgcttgcgaaggctgccagtattacgcacgacagcagacatgccagctaaagccctccaaaccatacccatcacctggccatttgcgatctgggggttggacttggtcggacccttcaagaaggtgcccggaggctacacccacttgatagtagcggtggataaattcaccaagtagatcgaggccaagccgatcgccaaactcaaatcatcagaagccgccgctttctttcgcgacatcgtctaccaatttggggtatctaactccatcatcactgacaacgaacccagtttacaggagagtcgttcctacagttctgcgacgacttcaacatccgtgttgattgggcagcggtgtctcaccaaagtgtaatggccatgtcgagcacgcaaacagcctaatcctacaaggcatcaagccgcgaatattcaacaagttgaagttcgctggatagtgggcgaccgagctaccaatagtgttctggagtctgcgaaccacaccgtcttggttgcggccgagctaccaccagttttcatcgacccattgaccgactggtgctcacgactgccgctgcttcagctcccttgcccccccttctccgatcttcactggcgccttgctatggcggagtatgtggccctgctagccaacctcacctagaacttggtgtggtgtcccctagcaccaatgtggtcactgacaaatggatattccgacacaagatcaaggttgatggtactttggattggtacaacgcccgttgggtccttcggggcttcactcaacgccacggagtggactacgacgggactttcagtcctgtcgtcaagcctgccactgttcggaccgtcttctcctagaactggacggtcccccagccggacgtcaagaatgtcttccttcacgacactctgaccgagatggtgtactacagccagctcgtcggcttcgtcgactccactcctccgggtatggtgtgtaagcttaaccactctttgtatggcctcaagcaggcgttgtgggtccggtacagtcgcttcgccatctacttggtctccctcgacttcgtcgaggactcgaggccaagtcggacacatctttgttcatccttttgggtgacgacgacaccgtctacctcctactctacgtcgacgacatcatattcacggcctccagtgtcgcactccttcagacacggtcgctgccctgtagcgctagttcacgatgaaggacttgggccctctccaccactttcttggggtcaccgtggagtgccgcgcctatggcctcttctttcaccaacgccattatgccatcgatattttggagcgggcttacatatccgactgcaagaattgctccatgcctattgacacacagacgaaggtctctgacgacgaggacgtcccggtcggcgatgtgactgcctaccggagcctcgctggggctctatagtacctcatcttcacccagctcgacatcgcctacgcggtctagcaggtgtgccttaatctcactattgctaagtggattcttcactacctctgcggcaccctcgactatcgccttcttcgatttttgagcgggttgaatacactttacaccgacgttgattgggttggctgccccgacacacgccggtccacctttgactatgccgtgttcttgggcgtcagcctcatctcttggtccttttgaagcggcaacccgacgtctcttgctccagtgttgaggctttctggttccgttagttcctccatgagctccatagccccctcgcgtgccaccttcatctactgcgacaacgttagcacggtctacctcttcaccaatcccgtgcaacagcatcacacggagtgtgtggagatcgacctccacttcatctgcgagcatgttgctgtaggcgatgtccgtgctctccatgtcccgaccttcgccgacatcttcacaaggggctcccatctacagtactatcagagttgcggtctagtctaaacatctgtccagtatatagttgtgactacgggggtgttagtgtgttatttattcctgtgtactctatatctgcaataggcctggccatatacttgggtatattaatatatcctctgccaccaattagggtcagggtttctattctatccaacacaaatattagttgattttgttgtgcaacgggaatttcagttgctgtgttgtgctgtagtcacaataatggttcaatgtgttcatttcagcagtagctgtgcgactgtttgtttttctgtatcattttgattactaatatattatccttcacttgtgcaaattctgcaggctgttattaagaggctgatgactgatgtgccatttggtgtgcttttatctggtggactcgactcttctttggttgcatctgttgcttcgcggcacttaaacgaaacaaaggttgacaggcagtggggaaataaattgcatactttctgtataggcttgaaggtaagtttcttgtttatcctcatcacagagcattgtgttcagttgagccatcattccagttctaacttgttttcctgttgctatgagtattttgacaatataagggatgtttattgggagtgatataaacagaaggaacaatgtgataaatttcttctgtttttttttcttttgtagggttctcctgatcttaaagctgctagagaagttgctgattacctcagcactgtacatcatgagttccacttcacagtgcaggttctcgattcctttttctgtacactacagcaaaaaacttttaatttaaatttattataaaaaataccaggagggcattgatgccttggaagaagtcatctaccatattgagacatatgatgttacaacaatcagagcaagtaccccaatgtttttgatgtcacgcaaaatcaaatctttgggtgtgaagatggttatttctggcgaaggttcagatgaaatttttggtggttacctttattttcacaaggcaccaaacaagaaagaattccatgaggaaacatgtcggaaggtaaagatatttttatgagtaatattatgtccaaagtttttggccaatcatttaagcagagtagtgcgggcatgttgcctctttcagttcagctgcttagacattcaatcttgctcacaacatgtcttttttatgctctttagataaaagcactacatctgtatgactgcttgagagctaacaaagcaacttctgcctggggtgttgaggctcgtgttccattccttgacaaaagtttcatcagtgtagcaatggacattgatcctgaatggaagatggtatgttgccattgttaggataatatcaagatatctaatatcactttaattcatttcttttattctaaccagcatgattcctttcttttgactattaacatgtaatttttagataaaacgtgacctcggtcgaattgagaaatgggttatccgtaatgcatttgatgatgatgagaggccctatttacctaaggttggaaaagttgctcttgttatttttgcaacgttactttttaaatcctatatgatgtaacttatgtaggttttattttctgtaaatagcacattctctacaggcaaaaggaacagttcagtgatggtgttgggtatagttggatcgatggattgaaggaccatgccagccaacatgtatgtcttctttttctttgttgaacctctcatgaaattggcccttgttgaacttgcagttgatgtttgttactgcttttcaggtctccgattccatgatgatgaatgctggctttgtttacccagagaacacacccacaacaaaagaagggtactactacagaatgatattcgagaaattctttcccaaggtttgtaagctgcattactcttgtaatgttattttggtctgcaattatccatgccttgccaaaaaaaacacaccttgttatttgggcctggaataatattcaccatgaaacagaagtctgtgccccacctacataactcttttgattattacagcctgcagcaaggtcaactgttcctggaggtcctagtgtggcctgcagcactgccaaagctgttgaatgggacgcatcctggtccaagaaccttgatccttctggccgtgctgctttgggtgttcacgatgctgcgtatgaagacactgcagggaaaactcctgcctctgctgatcctgtctcagacaagggccttcgtccagctattggcgaaagcctagggacacccgttgcttcagccacagctgtctaaccttatgtttatcacccagcaatgcttgaaacagcaaaggttgtccattgcttgtttcagtttccttccgatcatgtttttagttccatcaatcaagcaatggagacatgcttgtgcttcatacttggcagcatcgtgtttgggttttcactgggcagtactgtttaatttttatggactgaaaagactcagttttgtaaatattcgtcactgtgaccaattcctgtggtggtttatgtgatttgcagattgcagtggttagtgtatcttcccaattttcactcctttaacacttgtggttgtttgtgacgtgtgcagatttatcttttcatttcttcaatcaaggttttcatttcttaatctggagaggtgaactaccaaagaacagaacctaggtagaacatgaacttctccgtagatagaagtgtcgatactgtggataaattcccatcagccatcaccttacaggatggaatgcaagccaatatttcagtcgttcatctacggtttagctgtaatttgaactaaacagactactccgtcttagtcgttttagcacttttttatgtctattcaaatagatgataacaaatttagacttgtaaataaaacacatacatcaagcattactagttggttgctcgtgcgttgcgacgactcataataatatccgcataaactatccacaaaaaagatctaaaggttttttattaattgtctccgctcttcgcataatattttttataaacgtatggtaccataggcaacaaattagaaaccccatctctcgcctaccccacttccaaggtttcgtagagcaggaggggaagggaagatgcgggcatacatgtttgttgccagagaaggacacgacgaagatctggatatctggagacgacataggtagtatacctctagatacctataaggagagagcacgcaagcagggaaagaagctcagccagagcagctccaaacctagaggcacccgcaccaggcgtcagtccgagaagggcaagagaatgcgagtgtcttcccaacccttgatccgccgaagcgacacaccaccaccaacaacttcatagcatatgccgactgctgccattctacgtgccttggttgttcaatatttcagacctggattcctcatcgccaagataacctaagtgtggcaggcgccaccatgtcctcctcgacggcacacacagaaaagaccaggagcatgaccgactcgccccgtacccgcgtcgatgagcgtc

SEQ ID NO: 688 - protein, 591 aa, Zea mays
MCGILAVLGVAEVSLAKRSRIIELSRRLRHRGPDWSGLHCHEDCYLAHQRLAIIDPTSGDQPLYNEDKTVVVTVNGEIYNHEELKAKLKTHEFQTGSDCEVIAHLYEEYGEEFVDMLDGMFSFVLLDTRDKSFIAARDAIGICPLYMGWGLDGSVWFSSEMKALSDDCERFITFPPGHLYSSKTGGLRRWYNPPWFSETVPSTPYNALFLREMFEKAVIKRLMTDVPFGVLLSGGLDSSLVASVASRHLNETKVDRQWGNKLHTFCIGLKGSPDLKAAREVADYLSTVHHEFHFTVQEGIDALEEVIYHIETYDVTTIRASTPMFLMSRKIKSLGVKMVISGEGSDEIFGGYLYFHKAPNKKEFHEETCRKIKALHLYDCLRANKATSAWGVEARVPFLDKSFISVAMDIDPEWKMIKRDLGRIEKWVIRNAFDDDERPYLPKHILYRQKEQFSDGVGYSWIDGLKDHASQHVSDSMMMNAGFVYPENTPTTKEGYYYRMIFEKFFPKPAARSTVPGGPSVACSTAKAVEWDASWSKNLDPSGRAALGVHDAAYEDTAGKTPASADPVSDKGLRPAIGESLGTPVASATAV

SEQ ID NO: 689 - DNA, 3093 bp, Zea mays
tgggagctgggcatgcatctaacatgcacaggactctggtttttgagagatctcgtggtataatccactggtctccttgtttactgcacacatttgttttttaaaagtttatatatattattattttcgttctcgttgtcggctaatttatttttaaattaaaccttaaaaaataaaaaaggatggaggtagtactatggagtatggacggtgacgacgagtagtactcgcatcggaagcagtgaggcaggtactggaaccccatggcacatgcacaccaccgtctaaaaagcttcgagcggaggtagcagcaaacacatggtttttgtttcgcccccaaaaacaggttcccaatcccacccaccgcttctccttctccccgtccgttgctggtatggccaactttattgtggtgtggcggataaagaagatccatcctatcgctcgctgccgatgcggctgacgtctgcggtcgtcatctgcctaccgaaaactgggagcgggcggacggagcgccagcatgtgcagttccttccgcccccagatcgccatcgtgagaaaaatgcactttttaagcctgcttgttccttctcgttaacagtctcactgtcaccgtggctactctcccattagcttgtcaaactagcagcagtagtgccagtggttggtaacttgtttgctcttcttcctttttcgccccctcccaaatcttgagtggtattagcacacagatgcccaaataaaacagtacaaggagcagtataggcccacgcgcatggtgtcgcatgcgacgcccgtctcttttgtctccctccctggaatggataggttcataggtctcccctgaaaagtgcatgggctccaaaacaacgtccgcgccgcccgccgcttctcccctcccctccccgcgtccgccgattgtttgtgtggttggggtcccccgcccgatgcttggcggcgcaacggcgcctataaatccttggcctctcctctttctggcaacacaaaacacatccatcctccttgcaactccagtgctgctcactgccactgccagcagatcgagctgctccgtctcacaaaccctctagcttgctttgctgctccacctgcaagtctgcaaccgcgtacagagatgtcgacggtgagccgtgcgtccctcgaccagaagctcgccctcgccaagcgctgctcccgaggtacgtgcgattgtgcgaagcacactagctagcctgtttattacgcaggcagtacactgactaaactgactgatcgatgcttgtctgtgtgtcgcatgcatggtctgcagaggcgaccctcgccggagccaaggcggcagccgtggcgactatcgcctccgcgatccccaccgtgagtttcctttcacgtctctagcttaatttctcccgtagattaatcaggcgcatgctgcgcagccgtacgtacgtacgtacgcgtcgatcggtcgcgaaacagcccgtcgtcggccagtctctaataactgatcgtcgcttcttcagctggccagcgtgcggatgctgccatgggccaaggccaacatcaaccccaccggccaggcgctcatcgtctccacggtggctgggatggcctacttcatcgccgccgacaagaagatcctgtcgctggcgaggcgccactcgttcgagcaagcccctgaccacctcaagaacacctccttccagggcaccggccgtccccacccggctttcttcaggccgtgagacgtggccttcgtccagagctagctacctacctctttcagttcgatcgtcgtcagtgcaaagcaccaccaatgcctgaataaatttaactacgaggctagctgctgaacatcgatctgctactgctagtattactacggcgaggctgctgaacagcgctgtagagtagtattggtgctcagttcagaatgtataatgttacttctaccgattaaactgttaaaaaaccctagtacgcttatgtggtcaaataccacttatatctgtgagcagtgtcgcatctctatataaaggaatatgtatcttctcagaaagaggttagagacccaactctacatactgtttttttaatgtgttttctgagtgtgtggattgctagaaaagaaaacgtgcttctaccgacttttcgcgtctatactgctgacaggaggggaaatgagcaaatctgatgatccatgttaacattgatgatttgtgatagcgtggttctcagcgtaaccaaccttgtctgttattctcacgtagagagggagagagaaaaaacaataaagtagcactaccccaggagccagtgcgttttaaaaagggccgcacgcaccgttaccaaccatttgacacaagtgcaaaagcccatcacgcgtttttaaacgggccaaattctagttacgataggtttttttttctgtagcataaatcacctgtattgaaccgaaaacatcatacgccgccgcctgcctctcccgccggccgtgggctgccgcatcccggcctggtgccctccggcggccgcatccaaacccccccaccccctcgcgtagataagcctagtaatcagtctcggcggcgcgggacgctgtggcgggggagaccagtgcgagactgcgctgtcttgtccattggggggatttggggctgtgcgcgaggcagttaataatgcccgtcctctccccaagtcagagtccgctgccatggccgtcgccgtcgccgtcgacgtcccctcctgcatccagctcctccgctcctgcagcgcggtcgccggccggcagctccaccagctcctcctcaaatccggccacgtcccctcctcgctcccgcccactaactccgtcctcctcatgtacgcgcgcggctctccgctccactcccgcgacgcccgccgcctgttcgacgaaatgcccacgaagaactgcttctcctataactccatcatcaccgccctcttcaagtccggagaccaccgtgcggctctccgcgtgtttcgctccatgcctgacaggaacaccttctcctacaacgcggtgataactggcctcactggtgctggggatctcgacaccgcgagtgagttgct

SEQ ID NO: 690 - protein, 115 aa, Zea mays
MSTVSRASLDQKLALAKRCSREATLAGAKAAAVATIASAIPTLASVRMLPWAKANINPTGQALIVSTVAGMAYFIAADKKILSLARRHSFEQAPDHLKNTSFQGTGRPHPAFFRP

SEQ ID NO: 691 - DNA, 7117 bp, Zea mays
gctggctagctcgtcggcgacgggccggtgatgcgctcccgacgaatgcggtggaggtcgtaacgggcctggtgacctgcacgctgggcaagcgggcagcatcaagaaagcgctgatgagatgtgaggattgttgatcatttgatctgccggaggatgcgaactgtggtacatatacctggaacaaatatagttgcaaattctgtgcagttaaacatatacctggaacacgttgaatcgatcgtgtgacgactctaactgacgatgtacagccaccgtacccgtttcctgtacagatacggccgccgcatcgtcgtaggcacgtcgtcgttgtcgatctcccaatcatgtgtaccacttgcgcacggttggattggatcagtgttcaccaaaaaatttgtgccggcacgcggcacacaccacaacaacaaactgcatatcatggaggtcacctttgccaacacgtcacgctttgcccggctggtgcggtggtgcggatcagataaatgcatccgtagcttataaaaatggtgatagtgttttttcttcctgaaaatagaaatctagttttgtgataaacaaataatttttaatttaactatttatagacatagtttgtttttaagagaaaaagctaaaatgccataaaatttgagaattaagacagtactgcttatgataagcaaatttaaactcagaatatatttatataaaaaaatattgatatgagattgaccaagcgcttagcgcacacgagaatacgtacagaagtgtccttctgccacgccagtccacatctccacggccaccggcagacggcaccgaacaagggacacacgcgctcgtaggcagtaggcacgcacacgccgccacgtcgcagccacgagcccacgccacgaggccacgaccccaaaaacagccgtccacgtcgcttccccggtccggcgaccgcgcccgctgttttatacgcgacccggcggccgcacccggcttgcgcacgccgttcacgtcccccggcccccgctctcgtttcccccgcccgcaccaggcacgctcacgcgctgcgcaccggatggcccctgctaacgtgcgcgcggcgcaggcgcaggcccccagcgccgaccgcaggttaagtacgctagtggggcacctgctgccttcctccccacgaagagcagcagcagacacctccgccacctccaccctcgaatcgttccccaccatggcgtcgcagggatcctccgtcttcgccgcactcgagcaggccccggaggaccccatcctcggagtaagtccgtctccccagtcctttttagcttcctttcccacggtgatctggttgtcgctatcggtcgcgcggtttcgatgcgatcgcggcctcgtgggtttgctctggctgatcagtgttcgtttggtttctgggcaggtgaccgttgcctacaacaaggatcccagccccgtgaaggtcaacctcggggtcggcgcctaccggaccgaggtaagatgagtttggggatttgctatgaaccttctaattccccttctgtttttttattagttggattggagatggatttgacgctcctgttcctattctgatctctgcaggaagggaagcccctagtgctgaacgtggtcaggcgcgccgagcaaatgttgatcaataatccgtaagtgtcatgtgaaatccatatgacccgcttgatttcgtgatcgtgcctctgtggttattgaactttcaggcttaaagctcctgccctcagcccaagtggaaacggaaggggatttagatagttgctggatctaaaatctggataacacgcctcttaatttgactaatactttcattcgcatccataataattattgacttgtcctctgtaattgtaggtgacctttctgttcaatactagtttttaaataaattttcttctacgtttaggactagtcttttttttgcgactgtatctgctctgtcccactgccgtctaagattctcttctgtagtcgaccttcaattgctttccctcctttcttttttgtggtacctgaaaaattgaccttcgttttgtctgtggggggaatggtttgtcgtttgcaagcactgccatactccctctgtccaaattttcttaagtttgaattgatagaaaatattttcaaatgagtttattataaaactagattcgaaggttgatactaattatatatcataattattatatatatatatatatatatgtatgtatataattggtcatattatacattgattacgactgacttctgggaaagcgagagaagataaaaagggacgtatgaagtatgtctcgtgtgtgtacaagccactgatgcgaaaaaactgttggtgtggaagtttatgatacttgaagctgtattttagacacatttttcttcttatttctaggtcacgtgtcaaggagtacctaccaatcaccggtctggctgaattcaataagctgagcgctaagcttatctttggcgctgacaggtattctctgtttgactggtttacccattttcctcatttgtgggtcaactgttcctaatggtgatgttgtcaactgtgaattcttagtgttgaagtttcattacataaaaataagttccctagctactggttctggtttattcaggttttattacttcattagggagctgattttttttttgaatcgaatagccctgctattcaggagaatagggttgctaccgtgcagtgcctatcgggtactggttctttaagagtcggaggtgaatttcttgcaaggcactatcacgaggttaaacttttcttgctcctatctgttttgctgcttcctgattataatgcatgactgctaaatcatacaaatatattccagcgcactatctacatcccacaaccaacctggggaaatcacccaaaagtcttcaccctatctggcttgaacgttaggagctaccgctattatgatcctgcaacatgcagccttcacttcgaaggtatggatttcattttcatgctagatctattagatatgctataataatgtgagtatgctagtcaaattgacaactgtgttatatttttttatattcgttaatttttttatggctgtcattgaccaaattttgtgttgctttgcaggactcctggaagacctcggttctgctccttcaggttcaattgtactgctgcatgcctgtgctcacaaccctactggagtagatcctaccatcgaacagtgggaacagattaggcagctgatgagatcaaaatcactgcttccgttctttgacagtgcctatcaagtatgcagatgtgcagagcaaaagtgacttgacattgcaaaaaacacatctggatcctatacactcatcattcacatttttttgttaacctgacagggctttgcaagtggaagtcttgacaaagatgctcagtcagtgcgtatgtttgttgctgatggtggtgaacttctcatggctcagagctacgctaagaacatgggattgtatggagagcgtgttggcgctttgagcattgtaagataccttcactcttgttcttgttgatttcacttccgatcatcaggaaatcaaggttgttggcatcttcctctggtgttcagatatattcctatgtttaccatccaacttgtgagcttaatgctataggagcgattgatgtgtggaaaattctgccacttgtgttcaaatttgtattttatctccctacttgttacttgagatatgtcagttcatatagctcgtatctgtttctttatctgaaatcagaagtgcattgctatggatgggttgagttgtcaatcacctgtagtcactggtgactacaattttagccttttgccaggattgaattctttcgcatttgtagaatattatattaatgtagaaattgtttttaatgtacagtggacaaccatttacttccatcagttccagagatatttgactagttaaggatagtcatgactttatgccttatctgttaaatgatgatgttatttctcctacattatgcccttttgaacagtcttttaggctgcagagtgtcctattcatagtaactcttatgtttcaggtatgtaaaagtgccgatgtagctgttagggttgaaagtcaactcaaacttgtcatcaggcctatgtattcaaaccctcctcttcatggtgcctctatcgttgctaccatactcagggacaggtatcattcttgctattgcaatgccatattcagaggtgggtccaagagttatacaaagtggttacttcctgttgattgattctatttattaacttccagcgagatgttcaacgaatggactctggaactgaaggccatggctgataggatcattaacatgaggcaacaactatttaatgcgctgaaatccagaggtacttgtttctgtcaattgctatttttctacaaaatatgattaaatgttgtttgcaaagtaacttacccttttctcaattaccatttctttcatggtcttgtattgcaactcttggtgcaaatgtttttcttttgtcctggattaatgtagctgcttaaggcaagctatgtagctactgctgcatccaagatctcttggagtcttgggttatcagcaactattaaaataagagaactttctctttttaccttctcagttgatttatcaagaaattgcatctgaccttaaaatagttatcaatctgtgtgacttatttgggggagcactattaatctgtgcttggaatgtttctgttttttatctgaattgaaaggctataatgtcacattctttttgcaccagaaaagaaattaccattatcgaatctcaatgtattgttcctttcttttgtctttcgtttcgggtttcgggtcatagcacgatggcactcagtctcgttaataacgtgcaggaacccctggtgattggagccatatcattaagcaaattgggatgtttactttcactgggctgaatagcgaacaagtcgcattcatgaggcaggaataccacatttatatgacatctgatgggtaatttgtctattcaacttttataagtatattgtgtttcctgtatttttgtagtctagttgctacttaacagtggctactttggacttcttattaatcttatttgcctttcccccttaagggctagtttgggagtccaaaaactggaggggaattgtttggacttcttattaatcttattttagcccctccaatcccctccggttttgtggctcccaaactagccgtaagttggggtataggcttaggtacttgtcttaatatgttactccctctgtttttaaatatatgacatttagaaaagctaataggacacgctacttagttataaaaatgaatcattagcttgtcctacacttcgtagtacttttaagatcatatagcattgaacaaactggatctgcactatttgacattgatctaaaacgaggtttcattttctcactaccacatggcctttccacatgagttggagtggtttagtgtggaatgtaaactaagggctactttgtcaactcaactctattttcccaagggttttccattttctaagggaaaatgaacgaatttctcttggggaaatgaaaatcccttgtaaaaatggggtttccaaactagccctaaatttcatattaaaccactctaactctaacagtacacacaagaataaggccaacacatgggtctccaaacaagccctataatggaagtcccaactgtcatagctatattgacaatgtatatattctttttgcaggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagtactcagccagtggtatttactggttgacctactgtagtttgcgtcggaatagatatgtttttttactcttcgtggggcagttttgtactggtggattcataaggactctgattatggtgcgttcggaacttataataataagcacatgaaattttgcttcaggtgcagtgatgctgtctcattaagttattagttattaggttgctgtcttattaagttatcaggtcgcagctgggttgaagcggagcacctgtcttgatttatctcttctcttttctagagagcttctgtcattcgtgtgcccttttatatcattttgctctatcaatgattatcctacaatctgcagtagttttgattccgttttgttctttgcctgctgtactggctcagaagtacggtaatgctcgcaagctttgcggttgttgatttagggactgaaaggatctgtttagaaaggtgtcgatttggagactcaaaaggatcaagaccttccaaggaaggtgaattgagtttctctaaattttcttgtatgaattaaaaagttttgtatcataatttttaattctatactagcatgataattctatactagtgtgacagttcttagcgtgacaatcctgagaatataaatattttaattgaattgttcaaaataaatgttgaattacttaaacataaatgtgtatagtaaagattagaagacatcgattttttatggaggtcttgagagtccaactattctttattggagatctttttagtccacctttattggagatctttttagtccacacgaagatcaagtgctctctctgacggcacagttaattggtcacaaccattgtataaacccgagtgagttcacttataagctatttgaatgatcatcacactcctaatcaccatctatgtctatgtgaagtataagttctctgaatgatcatcacacttcaaatcaccatctaaatgtctatgtgaagttgattaccaagagtaccaaacactaaattacttaggccaaatcaaacctaatgagtgtgatggttgtgtaaatcactctaattgccactaataagctcgctaattatgtcattattagctctcaagtcccctcactagcaaaggatcttccacactctcaagtggcgtttcatgtg

SEQ ID NO: 692 - protein, 459 aa, Zea mays
MAPANVRAAQAQAPSADRRLSTLVGHLLPSSPRRAAADTSATSTLESFPTMASQGSSVFAALEQAPEDPILGVTVAYNKDPSPVKVNLGVGAYRTEEGKPLVLNVVRRAEQMLINNPSRVKEYLPITGLAEFNKLSAKLIFGADSPAIQENRVATVQCLSGTGSLRVGGEFLARHYHERTIYIPQPTWGNHPKVFTLSGLNVRSYRYYDPATCSLHFEGLLEDLGSAPSGSIVLLHACAHNPTGVDPTIEQWEQIRQLMRSKSLLPFFDSAYQGFASGSLDKDAQSVRMFVADGGELLMAQSYAKNMGLYGERVGALSIVCKSADVAVRVESQLKLVIRPMYSNPPLHGASIVATILRDSEMFNEWTLELKAMADRIINMRQQLFNALKSRGTPGDWSHIIKQIGMFTFTGLNSEQVAFMRQEYHIYMTSDGRISMAGLSMRTVPHLADAIHAAVTQLK

SEQ ID NO: 693 - DNA, 14054 bp, Zea mays
gatatttcacaaattttgtttcaaaattatgaatttgatttttttataaaaatggagaaaaagttctattaaaaactaaagggtactaggagtccaaaaatacatttgttgttcaaaaatttatcttttggcgaattaaacaaattataaacatatcttatcgaatttttatttttcaaaggtaatcaaaattttcagtggtaaataaccgaaaactgctcggttttaccggttttccgacatttttttaccgaatctcttttttcaagtttaaataaagaaccgaccggtaattacgaaattcgtcgaaattcgagcgattcatgttttcggagatcatcgaaaaagttgctcagaaatgagatgataagccttgctcgagccccatcccgcccaccggtagcacggtccctggtttttgagattgtatgctagattatgtagatatgtttctcataaaaatattcaaataaatgctatctttttacatacagatagagtctggtttgctaacacgtgtccttttttatacccatcaaatgcaccatataggcaagtgtacaatgggccagactcagggttcacaatttcctttcgaagattcgaattttatttttgtgattaaaatttgacttttgtatttttatattttgaatcaaaatccagttaaaaccggaccgaaattcgtttatcggtgagtagcgaaaacgagaaaaatggcaaaattcggtgttaccgaaaccagaaagtaaaccgtggacggaccccactgtagatccttattcaaggttagtttgataccttcaatcctctgtggttttcttactcctaaactaacctaccacatttaaaatgagtaacaaataaataaagaaaaacaaaaaggtaataacatttgtgagaagagctggagagcgaaaatataggcagtggggcccgtctgcgtgcgtggggacgcgacgcgagacaaggagagcgggtctggtgagtggtgactggtgggttggcaggcaggcgcagcgagggcgagctcaccaccacggcacgtcggcaccaccaccctccctctataaatgcagggacaccgaaataccgaatgctccccaacgccctatactaatccggaggaggggtcaaggaaggcgagcgacgctcccacaccaatccacaacaccgccgcgccgcccgccgccgctggggacgagcgtggggcgagcaaccaaatctaagacaccgatccccgacgcgcaggccgcgaagctagcggcggagaaaagatcggagccacaacgcggtcgtgagcccgcagccaccggttccgcgaggctagacggagacagaggtatccgctccagcacccctgcttgccaggacccgcgagacgctaaaaaaagttgacgggattggcaacttggcggtttggtttggctgcagcgtgcgtgtgtggttggtggcatgcgcggccgtctcgttgtttttatcatttcgacccgttgatgttttattctgcgtccgtccgtgcgctcctccgtgaatctggcgtgtcgcggcggcggaatctgcgccgccgtgcgggggttggtagatctgttcatccctgcgcgtgtttccgccgctgaggtgtttgtttcgtacttctttttttgggagtgctctgttacactgcagagtgggtcgcacgatcttttctggatgtttatggtgttgacatgtgggcgactgagcgtagggaaggggacagggacagctttgagttttctgcttgtatttccggtgctttttaaataccatttcccggatgtctggttcctttcccccccccccccccccccccccccccccccccccccccccccccccgcatggtgttgtagatcgatgaatcgctaagcgaacaccatctgatgctcgtcgtcgtttgattgttgcatggcagatagcgaggcttgctgttcagccatgtcgacggcgcaagggacagcgttgaagtcggcgccgataggcgcaggtcatcgggcccggcgcggccgccccgtggtgccgccgtaccgttctggctggcaagcatacggcggcgtttccctcgagggcagcgggttcctcggcggcctgcagcgcaccgaggagcgcgtcgctacgctggcgccccgcgcggcggcgcgcgacgcggaggtggtgaggccgctctcgaagctcccgaacagcagcattgggctctatgatccctcgttcgagcgtgacgcgtgcggcgttgggtttgtcgctgagctttctggcgattacaaacgcgagactgtaagtttcatcgattccttgaaagaggcgatgccacatgtcctgtagttatactatttcgatttatcatgttcgggatgccaattttgctatcctttttaccgtaggttaatgatgctattgaaatgcttgagagaatggcgcaccgtggtgcctgtggctgcgaaaagaacacaggagacggtgccggcattatggtcgctctaccacatgacttcttcaaagaggtgagtttctttgcaacaaaaagaaatagaagaaaagaaagcaaagctgttcttttcgacagtcattcaatgctttggtgttcccacaggtcacaaaggatgctgggtttgagctacccccgccaggcgactatgctgttggaatgtttttcatgccaaccgatgaaaagcgtcgcgagaagggcaaagctgagtttaagaaggttggtgatagcctatgagcaatgcaggatctgcatgttaagctcacttctcttattaataatcttgtccttgtaggtcgcggaatcactgggacatgtaatactcgggtggcgtcctgttcctactgacaactcagacttgggtgaatctgcactcgagactgagccagtcattgagcaggttttcgttaccaagagttcaagatcagaggctgagtttgagcaacaggtaattctataccactagatgtaattgcacatcagcatatttgatggatttggctttaacgttttttgatgaattgctgcagctatatatccttaggagactctcaatcatctctgtccgagcctctctgaacattaagcgtggaggagagagggatttctacatgtgctctctatcttcaaggttcttccctttcctcacctgaaaagtttttgtttatgctttggtttcattatgtttcagggttgaaaaggggcagagagtttccactaagcacggttttagaacagaattttggcaataattttgattttctataagggaatatcaaattattgccttcaatttggtcttaacagttgtaaatatgtagccaaatgtcattttggtcggcttatgtttgtatgaataattcttattcaaagttgtatttctttatattacaggactattgtttacaagggccagcttaaaccgtgccagcttaaggggtactactatgctgacctaggtcaagaaaacttcatgagttatatggctctggtaaatacgaaactttagcagtattacacaaaaattgtcatgatcatagtcaacggatgcgaaccaataatagcatggctgttgtaagaagatatgctcccatgcaggcatcatactttgaactgtcttatcatcactgctctactcatatgctattttagtcctggttcttgacgccttaaagtaaactattagaaatctctattagttgatacccgataaccatgttgcagagtcaagctgcagttctgctatggccgactgctatgcccgactcatcaggatgtgacctccgattaggtggtgggaaggaaatgtgtttggtttgaggtagcttagggctcccaactgttttgatgaaattctgtgctactgatgctttctttttggtagtgcaagtgcttcattctgatgttctattcagcatcttaaagctgcaaactatgtctgtaatatgatttctaaaatccatatattaaaacaggttcactcaaggttctccacaaacacctttcccagctgggaccgtgcgcaaccaatgcgtgttttaggtcataatggagagatcaatacccttagaggaaacaagaattggtaatctcgctaaactatagtttcatagtttatatttttgtgtggatacggtcatctccatattcttatgctgtttggattttatggttcttagcttgtctttaagtaatctggatttatgacaggatgacagcacgtgagggtctcttagaggcggagaagcttggattatcaaaggagcagcttgcaagaattctgccaattgttgatgctacctcttctgattctggtatggatgcacagttacagttggcaaatgaaaattgcctatctatcttttggaaacttattacctggaaaaaatgttaactgtaggcgcattcgataatgttcttgagcttcttgtccgtggtgggcgaagcctgctagaagccgtgatgatgatgatccctgaggcatggcagaacgatggaaacatggatcctgagaagaaagctctctacgagttcttgtcagcacttatggagccttgggatggacctgctctaatatcttgtatatatattctatccacttttcttttctaatcattcttctcctgattgttacttgatctactcaatcctaacttgtctttcgcctacagttactgatggtcgttaccttggagctaccctggaccgtaacggtttgaggcctggtcggttttatgtgacgcacagtgggcgtgtgatcatgggtagtgaggtcggtgttgttgatgttcctcctgaagacgtgctgagaaaaggcaggttaaaccctggaatgatgctattggttgattttgagaatcacactgtagtggatgatgaagctctgaaagcacaatactctaaagctcacccgtatggggaatggctcaagagacaaaagatatatctcaaggatattgtagaatcagtaccagaaaccgatagggttgctccaagcatttctagctcacttcctgtaagtccttaccgtgcaccaatattactagtgacaacttgggcaaaacataagtactgtagcgcttatgactcttataatttggtgcaggcaaagaatgagaacaaggaccatgttggtatcaatgggattttgaccccactgaaggcttttgggtaagcaagggatttattctgttctgttgccgtttcaagttttgctgatagttaactgatgtattctaggtacacggtggaagccctggacatgttgctactgccaatggctaaggatggagtggaagctctcggttccatgggaaatgatacaccacttgcggtgatgtcaaacagggagaagttgacttttgagtacttcaagcagatgtttgcacaagttacaaaccctccgattgaccctattagagagaaaattgttacatctatggagtgtatgattggccccgaaggcgacttgttggaaacaactgaaaaacaatgcaaccgtctttcacttaaaggtcccttggtttctattgatgaaatggaggctattaaaaagatgaattatcgaggttggcgaagcaaagtgcttgacataacatacccaaaaaagtctgggaggaagggcttggaagaaactttgaacagaatgtgtgctgaagctcgtgaagccatacgcgagggatatactattttggttctctcagatagaggttagaattttatctacagtagtatatttttattccatattttatctagcaggcaaaaactgtttgtaatcaagcttcctgtcaattgccgtgcagtcaaactatcaaaaattatgagaaattctcaaaatttatagatgtactttattatttactctatcaatatatcaaaattaaaattcaagttttaattcatcctatgttaagagataaaaaagagaaaattctatctaatatgaaggattaaaaaatatagttttttatctttttatatcttttaacatagtataaattagaatatattggtaaagtaaataatgaagtatatctgtaaattttttgacaattttttttgtgatgtttggtagtttgattgcatgacgattgcacgggaagcttgattgcataacagtttttgccttttatatgatatatgattataccaatcacccaacagttaattgaatttccctacatatgagttataaatgcattctacaattttgttggtctgttgctctattcatttgcaggatgtgccataactcacttgttccttttcgtttagcttgagaatagctctttacacaattcaattcctttgacagtccatcaaagtttcacacatggagatttgacttaattttgtttgcctaactttgttatgcaggattttcctcagaccgtgttgctgccagttctctcttagcagtgggagcagtgcatcagcaccttgttgcaaatcttgagaggacacgcataggattgttggttgagtcagctgaacctcgtgaagtgcatcatttctgcaccctgcttggatttggtgctgatgctatatgcccttatttggctattgaagcaatttggtgcttgcagaatgatgggaagattcctcctaatggtgatggacaacccaactcaaaggaagagctggtgaagaagtatttctatgcttctaactatggaatgatgaaagttcttgcgaagatgggaatatccacccttgcatcctacaaaggtgcacagatttttgaagctcttggtctttcttccgaagtgattggcaagtgtttcgaaggcacacctagcaggattgagggtgcaacatttgaaatgcttgcacgagatgcacttcgtcttcatgagttagctttcccatcaagaacccctccagctggcagtgcagatgcaaaggcccttcccaacccaggggattaccactggaggaaaaatggtgaagttcatctcaacgacccacttgcaatgggaaaactacaagaagcagctagagtcaacagccgggcagcatacaaggaatattcgaaacgaattcaggagctcaacaaggcgtgcaatttacgtggcatgctgaaatttaaagatatttctgacaagatatctttggatgatgttgaacctgcaagtgagatagtgaaacgcttttgtactggagcaatgagttatggttctatttcattagaagcacatactgcccttgctattgccatgaacaaacttggaggaaaatctaatacaggtatggttctcatccatacgtgatatttctctgttatagatgtggaggaattattgttcttttggcacattagctccatgaaaaaccatctgaacaaatgtaggatgtatggaccattttctagtttttgtaagggtgatgtgctgttcttttcctgaaacatgaacaacagctgcctacgttttattatgtgagcctgtcctctgcactaacattttagacaatcacgttttattatgtgagcattgcttctgaaaacatatcatactgttttgtttgttatagtttattgcaagatatttttttgcttttataatttttaaacgctagtgctaactgatgaggacatctgctataaatttctttggtttaatagaagtggttaaatactgctgtatgcattgttcctttttgattataaaccccttcaacttgttcttatattgtagttcaggaacatgagcagacagtgtgttttctagatcttaatattaaatatacttattcccaagtctaagatttatgtgaccaaatacacttgctttaatatatctgtgaaggtgagggaggggaacagccctctcggatggaaccacttcctgatggctcaatgaacccaagacgaagtgcgattaagcaagttgctagtggacggtttggagtttccagctattacctgactaatgcagatgagctgcagataaaaatggcccaggtactttgtcaacattgtgcactatgcagccgttaacatgaattgcatctttttgaaagaacatgggtcttccatatttcattttggatttactgttttttaccttaaatttctatagggtgccaagcctggtgaaggtggtgagcttccaggccacaaggttattggtgacattgctgtcacaagacattccacagctggtgtaggactgatcagtccacctccgcatcatgatatttattcgattgaggatcttgcacagcttatacatgatcttaaggtatgaattgtaaatagagtaatgctgctttctatacccacaagatccatggctcattgattgttgctgttggctcaatttaattttttacactcgtcttaacaacctctgaaggcctctcttattgatcttaatattcgcggatcacttgctgtgaggcaactcttgctactttttactggtgaacttgcatgtatgtttgcgaatctccaacttgcaaatgctgttcagtgataatgatattcttgcctgtgcagaattcaaatcctggagcccgtatcagtgtcaaactagtttctgaggctggtgtgggagttgttgctagtggtgttgtaaaaggacatgcagaccatgttcttatatctggccatgatggtggcacgggagcttcaagatggacaggtatcaagaacgctggacttccatgggaacttgggttggctgagacacatcaaactctagtagcaaatgggcttcgtggtcgagctgttctgcaaacagatggacagttgaagactggtagagatgttgctgttgcttgcttgcttggtgcagaggaatttggttttagcactgcaccactgatcacactcggttgtattatgatgcgaaaatgccacatgaacacttgtcctgttggtatagctactcaagacccagtgcttcgagaaaagtttgctggagaaccagagcatgtcattaacttttttttcatgcttgctgaggagctaagagaaatcatggcaaaccttgggttccgcaccattactgaaatggttggacgttctgatatgcttgaggttgatccagaagtagtgaagactaatgagaaacttgagaacattgatctctcactaatcttgaaaccagcttcagagattcgtccaggtgttgctcagtactgtgttgagaagcaagaccatggcctagacatggcattagataacaaactaatagatctgtcaagaactgctattgaaaagcaagttcgtgttttcatcgagactccaattcagaacacgaaccgagcagttggaactatgctcagtcatgaagtcacaaaacgttatcacatcaatggattgcctgctggtacaattcatgtgaagtttactggaagtgctggtcaaagctttggtgcttttctttgtcctggagtcactcttgaactggaaggagacagcaatgattatcttggtaagggattatctggtgggaaaattgttgtgtacccaccaaggaacagttcatttagtccagaggacaatattgtcattggtaatgtggctttatatggtgctaccatgggagaggcatatttcaatggtatggcagcagaaaggttttgtgtccgcaactcaggtgctcaagcagtggttgaaggaattggagatcatggatgtgagtacatgactggaggcactgtggttatccttgggaaaactgggcggaactttgctgctggcatgagtggaggcattgcctatgtttatgatgttgatgggaaattcagtgctcgctgcaacaatgagttagttgatctatatcatgtggaggaagaggatgacatcatcacattgaaaatgatgattgagcaacatcgtcgcaacactgagagtgttttggctagagacatactctccgattttgataatcttcttccaaaatttgtaaaagtatatccaagggactataagagggttttagaaaacatgaagttggaaaagagtgttgctaatcatgcaaaggagcctaagatggtaaatggaatatctgtgacgactaaggtgagatacattttcaagtgccaactttgtttcatttttcatatcacgagtttctacttagctatcctaaactattaattcatctacctaaacatttctagtttagttatcatttcctattcattcaatagggaattaaatctttgcacaaaaactttattcgtcagaaacagctaataatataattccgattcttggaagctttcattgactacttgtatcaactttcatgtacagaaagtacaacctgatcagtcagcaagccggccaacacgtgttgccaatgccaaaaagtaccgaggttttattacatatgagcgagagagtatttcttacagagatccaaaagagcgtgttaaagattggaaggaagttgcaatcgaatcaacacctggtccactattaaatacacaatctgctcgttgcatggactgtggtactcctttctgtcatcaggtgatatttctattcttgctatatatattcttaaattctctttccatcatggttaagatggatatattttatttattcagatgctgaattgaagttgtttctctagagtacttctgtaaaagaaacatgcgtttgtttcttttcttttctgctgttgataagattttggaactctctttttataacatttttattatactttcacaggaaagctcaggtgctggctgtcctcttggaaataagatcccagaattcaatgaattagttcaccagaacagatggcgcgaagcattggatcgactacttgagacaaacaacttccctgaatttactggacgagtatgccctgctccttgtgaggggtcatgtgttcttgggattattgagaatccggtgtctatcaaaagtatagaatgtgcaatcatagacaaaggtttcgaagagggatggatgattccacgacctccacttcaaagaacagggtgtgtgttttaaagttataatcatttagttttctccgtgtttggagtttaatttcgttactaggtagtatctcagttatgctcattagcagtgaaatgttccttttacagaaggaaggtggccattgttggcagtggaccagctggtttggctgctgcggatcaactaaacaaaatggggcattttgtaactgtgttcgaacgtgcagaccgaattggaggtttaatgatgtacggcgttccaaacatgaagactgacaagattggcattgtccagcgccgtgttaacctaatggcagaagagggtgtcacatttgtggtgaatgccaatgttggtagtgatcctctgtactcaattgaacgtctacgttctgagaatgatgcagttattttggcttgcggagcaacaaaaccaaggtaacaaactaaggttccagataaatttttgaattttgattgatagtagcttctaaatatatctgtgtgtttgtttgtaagatacatatggtatataatttttaagtacaacaaaaatacacacgatgcaacatatacttcaaatagtcgtgctctattttgacctatggtcatgtccttaacagagatctcaccatccctggacgcgagctatctggagttcattttgcaatggaatttctccatgcaaataccaaaagtttactcgacagcaacctggaggatggtaaatatatatccgcccgcgggaaaaaggtggtggttattggtggaggtgatacaggaacagattgcattggcacatctattaggcatggttgcaccagccttgtaaatcttgaactcctgacaaaaccaccaagcaatagagctgctgataacccatggccccaggtatctgtctctctttgcagtcatttatcactttctttagggtactgtatttatgtgctgtttggttcacatatttgtaacgtgaacggtaaccgataacgttaaatcatgattgttcaagtccaaccgtaatgagatatcacactagaaattaataccgtcctattcgaacttgttaccgctggtagtcaagtgtgaatcattatcgttgtcatttatatatgttacatttcgtgaaccaaacgacaccttagccttagattgctgagtgcaggaatatatcgttgcttgtgcatcttttccagcttggagttgttatttgcttatttctcctttttttgcttttagtggccaagaattttccgtgttgactatgggcatcaagaagctgctaccaagtttggaaaggatccaagaacttatgaagtcttgacaaagcgttttattggcgatgaaaatggcaaggtgaaggctcttgagttagtgcgtgtgaagtgggagaaagtagatggaagatttcaactcaaggagatccaaggatcagaagagattattgaagctgatctcgtcctcctagctatgggattcttgggtcctgaagcggtcagtacccttcaaggctatttattataaaagcccctaagtaccactgttctagtctagtgcctaacgtaccatttatgagaaatgtctgccaactaatagccttttcttcctgcagtctatcgctgagaaactgggtttggagaaggacaacagatcaaacttcaaagcgcagtttggagacttcgctaccagtgttgatggtgtgttcgcagccggggactgcaggcgtggacaatcactggtggtatgggccatcacggaggggcggcaggctgctgcagcggtagacaagtacatatcaaggcatgatcagaatgtcgcaggcgacatcactccctttggggcagggctcgttcagccggttggagcataaaaaaaacatagaccgaggcatgttttaggttctcgtcagtggttcctcacagcaaattttgttcttgtatattttgacgatagataaacagttgaaagttttggtgtctattgtttctttttcttctccggttattatgttttgcgtgtctgcatgtggttttctagtccaaaatgtacagttttccttttattaaatagatgtaaatttggtgggtgatatggcgatcattttgtgtgtatatgaaagcgaaattgagccaccaatctagttgagttggttaggtagttttagtagcacttgttaggtaggtcatgagttcgaattcgaatttaaagatacggttaaaaatgtcactcgttagatctagcctacagaggacggacagttgcacgagttttttttagctagttagttatttctacgttactatggtttctatattatatatatacctgtacgttgcaatgagaagataaaataccacgataactcatgtacaaatgtgttataatattataggaaaaggtttcataatttatttgtgatcctacccatacattaatatacaaaacactaattattatatatttttgttagtatcactaaaagtagatgtttacataccttaaaagatataggtgtatattcgtctgttgctatgaaatcaatatgataagatacattgatatgcaaaaatactaattattattctatacttttgttagcatcactaaaaatagatgttttcatatcttaaaagatatagtaaggtacatgccagagtaattcactttttaaggaatatactctgacatcatgaacttagaaaacttgctagcagcaatccaccgcctactgtttgtctctctagaagaggtagccagctcctcttccttcaaatacatggaatgcttggtgtgatttgagtacacggaatgacaatttctacaatcagaagctgctaactgcatacaagcaaaacaaaaggaataattccattccacattgaatcagagattagaagttggagcacaacttgtttgtcagttttttgccgaagctcgacgaaaattacaaacaggaaatggatagagcaagaaaaggagtgctccaaattaatgacatctaagtaaaaggatgacactcaaatatggagttacaagtagccaaatttaggtatgacactcaaatctggaacaacccaaactgtagttctttagactcctg

SEQ ID NO: 694 - protein, 2163 aa, Zea mays
MSTAQGTALKSAPIGAGHRARRGRPVVPPYRSGWQAYGGVSLEGSGFLGGLQRTEERVATLAPRAAARDAEVVRPLSKLPNSSIGLYDPSFERDACGVGFVAELSGDYKRETVNDAIEMLERMAHRGACGCEKNTGDGAGIMVALPHDFFKEVTKDAGFELPPPGDYAVGMFFMPTDEKRREKGKAEFKKVAESLGHVILGWRPVPTDNSDLGESALETEPVIEQVFVTKSSRSEAEFEQQLYILRRLSIISVRASLNIKRGGERDFYMCSLSSRTIVYKGQLKPCQLKGYYYADLGQENFMSYMALVHSRFSTNTFPSWDRAQPMRVLGHNGEINTLRGNKNWMTAREGLLEAEKLGLSKEQLARILPIVDATSSDSGAFDNVLELLVRGGRSLLEAVMMMIPEAWQNDGNMDPEKKALYEFLSALMEPWDGPALISFTDGRYLGATLDRNGLRPGRFYVTHSGRVIMGSEVGVVDVPPEDVLRKGRLNPGMMLLVDFENHTVVDDEALKAQYSKAHPYGEWLKRQKIYLKDIVESVPETDRVAPSISSSLPAKNENKDHVGINGILTPLKAFGYTVEALDMLLLPMAKDGVEALGSMGNDTPLAVMSNREKLTFEYFKQMFAQVTNPPIDPIREKIVTSMECMIGPEGDLLETTEKQCNRLSLKGPLVSIDEMEAIKKMNYRGWRSKVLDITYPKKSGRKGLEETLNRMCAEAREAIREGYTILVLSDRGFSSDRVAASSLLAVGAVHQHLVANLERTRIGLLVESAEPREVHHFCTLLGFGADAICPYLAIEAIWCLQNDGKIPPNGDGQPNSKEELVKKYFYASNYGMMKVLAKMGISTLASYKGAQIFEALGLSSEVIGKCFEGTPSRIEGATFEMLARDALRLHELAFPSRTPPAGSADAKALPNPGDYHWRKNGEVHLNDPLAMGKLQEAARVNSRAAYKEYSKRIQELNKACNLRGMLKFKDISDKISLDDVEPASEIVKRFCTGAMSYGSISLEAHTALAIAMNKLGGKSNTGEGGEQPSRMEPLPDGSMNPRRSAIKQVASGRFGVSSYYLTNADELQIKMAQGAKPGEGGELPGHKVIGDIAVTRHSTAGVGLISPPPHHDIYSIEDLAQLIHDLKNSNPGARISVKLVSEAGVGVVASGVVKGHADHVLISGHDGGTGASRWTGIKNAGLPWELGLAETHQTLVANGLRGRAVLQTDGQLKTGRDVAVACLLGAEEFGFSTAPLITLGCIMMRKCHMNTCPVGIATQDPVLREKFAGEPEHVINFFFMLAEELREIMANLGFRTITEMVGRSDMLEVDPEVVKTNEKLENIDLSLILKPASEIRPGVAQYCVEKQDHGLDMALDNKLIDLSRTAIEKQVRVFIETPIQNTNRAVGTMLSHEVTKRYHINGLPAGTIHVKFTGSAGQSFGAFLCPGVTLELEGDSNDYLGKGLSGGKIVVYPPRNSSFSPEDNIVIGNVALYGATMGEAYFNGMAAERFCVRNSGAQAVVEGIGDHGCEYMTGGTVVILGKTGRNFAAGMSGGIAYVYDVDGKFSARCNNELVDLYHVEEEDDIITLKMMIEQHRRNTESVLARDILSDFDNLLPKFVKVYPRDYKRVLENMKLEKSVANHAKEPKMVNGISVTTKKVQPDQSASRPTRVANAKKYRGFITYERESISYRDPKERVKDWKEVAIESTPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMIPRPPLQRTGRKVAIVGSGPAGLAAADQLNKMGHFVTVFERADRIGGLMMYGVPNMKTDKIGIVQRRVNLMAEEGVTFVVNANVGSDPLYSIERLRSENDAVILACGATKPRDLTIPGRELSGVHFAMEFLHANTKSLLDSNLEDGKYISARGKKVVVIGGGDTGTDCIGTSIRHGCTSLVNLELLTKPPSNRAADNPWPQWPRIFRVDYGHQEAATKFGKDPRTYEVLTKRFIGDENGKVKALELVRVKWEKVDGRFQLKEIQGSEEIIEADLVLLAMGFLGPEASIAEKLGLEKDNRSNFKAQFGDFATSVDGVFAAGDCRRGQSLVVWAITEGRQAAAAVDKYISRHDQNVAGDITPFGAGLVQPVGA

SEQ ID NO: 695 - DNA, 9268 bp, Zea mays
cctataaaaatgccctataatttgaaaatgagtatattttatagaatttagggcaccaacaaaacaccccgctccaacagtaaagccccaaatctagattatagggcagcccactacggtgtagtatatttgagtcacttgagagggtgccctatagttttttgacaaaattttatgaaatggagcactgttggagtagtttttcctgtgtagagccctatatttcaatttgaggcactagtttgaggcattgttggagatgctcttacaaatacacggaacatatttgggttcagcaacagggacggacggacggcgcgccgtgttctacagacttgccgtcgctgcttctgcatctgttcgaaaaccgtaacccccgtgcaccgctggtcagtagtcgtcgtttcgtttcgtttcgtttcgtcgcggcgatcttcgaaccgatgaagcgtggcacttggctggttggtggtggtacgccgggccagaaggtgacctgcctcgatccgaataccatgcatcgatctgtgcacgtgcctgttctcttcctactccgattaccgatagtccgggccgggaaaaagagcgcgaagccagatctgaccactaggggtctgtttggttggtttctctcgccaacctggctgtgtgagccaggatcactggagcctggctctgaagatacgaccaatctgctcgtatctggtgagcctggcccaaggtgctttaaggatcgtgcgagtctggattcaaatctacatgcagacaaccaaacacagagctcgcacgcgcatagcttggctcatagcaaccaaacagcagctacccgcatcccgcgacgcaagcacgcgcagatgcaggcaaccaaacagaccccaggtgatccaggtcgtcgaatgttccacgcgaaccgcagccgcgagtgccgtctccggctccgccacaggtagagctcagagcagaaaatgctccagccacctgtctctcttcttcctccttcctgccctgcacgcggctataagtacccaccgccatctcactttgcccagcagcacggcagtagctgcgccattgcacgcctccggccggcggctgcttgtcttgctgcttctgccgcacatccgtgatccgtacgtcgtcacctcaccactcacgcacaagcacaaagagcgttaatttcttgctggagattctattctatttctatggcgtgtccctgatcgaatcctaaatcctaaacctctgtggtgcactgcagggcagaaggtgcttcgttcgttgcaggcctggcgccacgccgtaccgtgcaagcgcgtttgctgatgttcatctaattactgtataataatatctccgggcgaaagagctagcaatcgtcggcgggggaggaggggctcgattgctgctcaaggtgagttgtaattccttggctctggatttccctatctgttggctgttcatggatcatccaatggatggatggcgctccctgttctctacacctgcgtgctcttcttccctcgcctcgccggggtcttgtgtcagttactgtatctccctgttgattttaaaatctaagaagcaacaacaaaagatgattcaaaaaaatattcaaatttgaaggaccacaatgcgtgtgctactgctagctatgctaccattagagcatgccttcactgcattcttcttcttttgttacgagtgcttaatctcatggctcgctcccttaattcttgctaccattagagcatcttcaatactttctaaaaaaaaccacttgacaaactaatgaaatcagttggtaaactaataagtttcacgagtgactaaaaaaaagataggagctagcttctagtcctagataatgctcttatgagctttccttgtccagttgtcccaactcccaacgaacaaaaaaaaaaaggtaagaaaacacatttggcctttcttcttttttcttttcaactcaaaacgatcgctcagttacaaaaaaaaaagagagcttgcaattgcgagcgagataccaccgttacagggaaaaaaaagacaagttgttcaagttctctactagcttcctagcgcttccgtgtcgttctagatgagcttctctagcaaaggacaataatttggttgccacgtcagatgtcgactcagtgtcatttgctaccagctggcttatcaacttgggagattattgctcgcacctggacccggtgtccagtcaattattaatgatgttgatccatcttcgtatttttatcttggcaagaaactgttagtattaagttactgtcacctttggaagctgaatctcccctcgaagatatcagtatgggcatatagccatccgttcttatacacagctatttacgtctattttacaattttatatcttcgtcttcctcttttacacctacattcgaaccatctatttagagctttcaatgtgcaattcgtctttggtcattgtcaacatgaaccgtccagtgataatgctttgatgctgactaagaagtacggtctccgttcttaaatatttattgtctaatatttatttttaaaataaaacatgataaataaaaaagaacggagtgagtagaatacattgtgagctgttgttggtttgttgcacattctttacttgtttttttttacgaacatttgttgcaagcatcagcaaagccgtataaacttgtgcagctctagatagcgatttttttaaacaaaaccttaatattagattttggagcattgatttagaaagctgagcaactccaatgggagaggtgtttattttctcgtccatccacatccgccgttggcccgttgtttcttttctacccgcgcctgtggggcccaaccgtccggtcaaccgaccagcgtttcctgttccaccgtacgtcgtcgttctcgttcggtcgttttcgttcccctacctccagtccagtcccaggtccgagccggaccttgatcgccgccgtgcctcggcgcaaggaatggggccttcggtcttacccttgcacgcgccgccggcatcaggagacgtctctgtgtgcttcgccgtgccttcagccgtagccggcgccgcatcagcgtgctccagagaggaccgcagcttccagcacgtgtccctgacaccgccccacactggattgggaagggccgctgaccccacgcacctgcccgctggccagtgttggaaggtttgggaaatgagatgttgattttaagctgacttttgagggttttagcttacagctttttaaatcaatcttcgaccaacggtttgaaattccgtgtttagagttgaattactcgattcagaagtttaagtttctctaatttaagctaaagggagaagagatggagcgcctggcttgagttggccgcacgcagctgggaagaaggatctgaaaacactgtcgtccatgtattgattcacttaaacatttgtccgtatctattattttaatttttttataatctacggtcacaagatatgcctgtgttgtttgtgaatagaaaacactgaacaatgattgtgagtcaacagctatcattatttgtgttttggttgtgcgagggtatactaatgtctaatgattggctaaaccttagtcttacatcgctgtctttccttgcgctgtagggcaaggcaaccaccaattgggtaaaagcatataagcaggcttaccgatcaataaatataaaaaagggtagctttcaagaagtctgcttatgtaataccattattttccttttttttacctcgaaggagtgataatcaccaaaatagcattatattgtcatcatacggctgcactatctttttcttctgtaacatgccgtctaattattatcttcagtttcagactcagttatttgaaacatcaagatggttaatttcggaaagaaattgatggctgatcaagtggacgaatggaaagggtatgacttttcttttggtacttatgaaatcatctatttttatcttatcagggcaaatgttctttattttcatatatgcccactccactagtccactaggatacattagaacaccataccgtagttatcaccatatcacagtccttactatcattatctggttaattttataattaaattaaacaaaatctagcagttatcgaattgataggttgcactacaataatgaagtcacttcccgctaatgcaagctaatgtcactttgtttaacggtttatcagaaatcttatcagctttttggtctttccatttctagatactacatcaattacaagaaatcttatcagctttttggtctttccatttctagatactacatcaattacaagctgatgaagaaaatgttaaagcaatatgtccaacaaacccaacatgatgagaaagatcgcgaacaagttcttaaagacttttcaaggtttcttgatgaccaggtatacaaagaaagatttcccttgaaatgatcataatatatgattttgagcatcatctatcctgtcagtagtcacttgtatccttgtaaggaacagaacagtgtcatgcgacaagcttaatagtcttagtgaattgggatcatttttcttagttgtgagctaaaatacacatgtatttcttcgttccagattgaaaggattgtgctttttctgctacaacaacaaggccatcttgccagtaggattgagaaattggcagaaaaacgcactgctcttctggaagagtatgacatatcacaagtttatcagctgcatgatgcatacagggaagtcgggcttgatctcataaagcttctccgctttgttgatgtgaatgctactggtatacgcaagatactaaagaaatttgataaacgctttggctacaagttcactgattattatgtcaccactcgtgcaaatcatccttattctcagcttcagcaagtatttaagcaagtggtaattttcatgcattttgcattttcctttcttgatgtgtgaagtaattcccagtacctattatttatcatggactcatacggatgcagggaattgtagctgttgtaggtgcattatcgcgcaaccttgaatatctgcagcatcatgaaggaagctttgtatccatctatgatcgtccagcagttaccttgaaggtattctattttcactattccattctcatttcagaaattctgctattgaatttataaatgaaaaccttgaaaggtgctctttcttacctcggaactgcatcaattatatttccacatgaagtagggtgtgacatgacacttttttgttgttatattcaggaccctattatagaccaagtaaaccatgcagtacagaaactcacgcatgccacgaattttatgcaattcttgggacagcacgcgcttattgtccaggaagatgcagaaagcgagtcggaggatcttgttggtgatcagagctaccatttcatgtccctggtgcttaatctagtgaacacattcctttacatggtgaatacatatatcattgtgccgactgcagatgactatgcagtaagccttggggctgctgcaactgtatgtggtataattattggatcgatggcagtcgcccaagtattctcctcagtctacttcagtgcctggtcaaataagtcctacttcaaacctcttgtgttcagtagcattatgctgtttcttggaaacctactgtatgcattggcatatgatctgaattcactaatagttctcctgactggacgactgctatgtgggtatgcaattttctcaattcactctatctcacttgatttacgttccacttttgtatgctagcattgatctgggtgaaaattactagtatgacaaatgcaggttgaggatccttaagctgagggcaatattctagaatatttatattgctgaatagaaaacaaaatggaaactgtatatcttacaaggagataaaggattttaaatctcgagactggcattaaaatatatgcttttctatttcttttatagaacttaactagttatccctacctccctttgggctagtaatttgtctatattgtttaaggttcttgattttctgacggtgcatctgtgatcgagctgccagcatgtaatgtgcaggttaggttctgcaagagcagtgaaccgtcgctatatcagtgactgtgtgcctctcaagatgaggctacaagcctctgccgggttcgttagtgctagcgctcttggcatggcatgtggccctgctcttgctggttttctccagattaaattcaagatatactcgctcagttttaatcagagcacattgcctggatgggtcatgtgcatttcttggcttatttacttattgtggttgtggcttacattcaaggaaccagaacacttcactaaaactctggtcaatgaacagccgtcagaatctggtaagctaacaatacactgaaatggcaacatgttttgtttgaattcatgaatatgctcgaatcaaaccttattgtacaatcaggatgtgtatgcttatcattcttaggaacttttctgagatgtttatttccttattatgaaaataggccgccaaggaaattctaacttggaggcaggtctagctgaaccattgcttcaaggtatagaacgaaggcaggatgagaactcagaagttaatgatgatactgaagtagagtcagaaagctctcatgaaccagcaacatcaattgcttcagcatacagattgctaactccatctgtgaaggtttccttccccctcccttcccaattatcgatttttctttgtcttgttcttggttcaaacgtttgaaagaaagaagctcacaatctacatagggttcttttgtaaataaagttagataaattaactatataatataataaaactgcatctttaaatagtaatgggtaaatacattccagttactagtaggtacatctgcatgtcatacaagcaaacataacggacacgccatgtaaaagaaactaggccaacctaggagaaactaggttgcatttattattatattattattaagatgaaaataggcacccaaatttaccttgacaaggacttgaacctaggtggtctgggtttacgagcacacccttgaccaagtgagctagctcagttcccttgacacaccagccagatgaaaagttgcatgtgcagctacccctttttccacgcccttttcatcttccaatctttgttggagctaccttctcatgtattcatatctttaaaaaatggttgtttgtcaggcccagctactgatatacttcatgctcaagtacgcaatggaaatactactatcagaatcgagcgttgtcaccacatactattttagctggtctacaagtgctgtggctatctttctagcgattcttggattaacggttcttccagtaaatgccattgttggaagctacgttacaaatttattcgaggataggtaagctttgtactcttacaaaacatactacatgaaacttttatattctctagacattgtttttctcttaaactgagacatgctttcacaaaataagaacttgctctatcatttgcaggcaaattttgttggcatctgaagtcatggttctcatcggtataatcatgagcttttgtttcacacctcactactccatcccgcaatatgttctttcagctttcatcacatttgtatttgctgaggtgcttgaaggtatgtatgtttatatacattaatggtttgagacagcgaaacctaaatcaatcatacgctgctgatttatcagccactcaacttctaacctcgagctatgcaggagtgaatctgtccttgctctcacgagtaatgtcatcgaggctttcccgagggacctacaatggtggactcctttcgacagaggccgggacgttggcccgtgtagttgcagatgccacgattactgcagccggttatctcggcacggacctccttctgaatgtcactcttctcccatcccttgtgatttgcatagtctccatcgcagcagcactctacacttacaacaatctctattgaagctattgttgctgtacaagtgtacaacaatgttcctaagctaaaatgttcctgcccacaacgggtttgtatatctgttcaagcatggtttgtaaacattttgatcaagtttgtatgcaaaatttcttgtatttagtgcatttatgtaaagattcatcctgtaaagaattataaactatgagacgctattgccatttatgatcatttatgtttatctttttagccttatgttatttgaatttgtctaatcaatgccatcttccatcacgagcacatcattgacatattactgatggatagacctttttgggacgtgagatgctaaaggcacaacctatatagctgaaaatttctaacatatttatcaataataccaagatgcctttgttgtttatcaattgcacattatttcaacgtaaatgcaattttgttaaatatgtcatggtgtcgagcctactgcttaccccagcatgttgaattgctgccttaagcagaaacatcgaaaaacctgcgtagattccacgatccaacaatcctctccgttcatttttttagttccatatgaaaggaccgattacgtctgaaagaagagtttcattagacaatctatttcttttaactaatgcctctagtttttcaaaacctatgcaataaataggtgtaactatagttttgactaagggttgtaatctctttgtaaaatatttatgcaatctcgatttcaaatctatccactagcctaacaactaataagataaaacatacaaccaagatacataatataaatacgggagcttaaatacgatatacatataaactcttattgatgactccattgtttttatcgagataccaagaaagacgcaagtttctccctagtcctcattggagcccagtccgcgcgagtaccaagctctcggtcaggtaacattgtggatagcctaggttttttgccacacacaagtgggtctttagtgtagcctcttctaaatgctctctatcaaaggtggtccaggaaaagattcaaaatggggccctagcagtagtagtattactactaacaacaataatgataaataagtaaatgctcaatgtgcataaaattgatctaagaagtacttgtaaactcatgtaatgttgtaaacttatttgcttatttctttatgtttcttttctcacatccgaacagattccttctagaggacatgattgtaagttaaaa

SEQ ID NO: 696 - protein, 328 aa, Zea mays
MRLQASAGFVSASALGMACGPALAGFLQIKFKIYSLSFNQSTLPGWVMCISWLIYLLWLWLTFKEPEHFTKTLVNEQPSESGRQGNSNLEAGLAEPLLQGIERRQDENSEVNDDTEVESESSHEPATSIASAYRLLTPSVKAQLLIYFMLKYAMEILLSESSVVTTYYFSWSTSAVAIFLAILGLTVLPVNAIVGSYVTNLFEDRQILLASEVMVLIGIIMSFCFTPHYSIPQYVLSAFITFVFAEVLEGVNLSLLSRVMSSRLSRGTYNGGLLSTEAGTLARVVADATITAAGYLGTDLLLNVTLLPSLVICIVSIAAALYTYNNLY

SEQ ID NO: 697 - DNA, 9281 bp, Zea mays
tagatgtgttggcataaatcgccaaaagagggagattgaaagggaaatgtgccttgggcaatttctagttgttttggtgattaaatgatcaacacaccacttttaactaacattgttcatatgagcatgagcacaggtttaagtcaagaaaattgaatatgtgaagtccaaaatgagttggattggaagacaaaaagtgtaaccttgggtaaaactataaaaacagaaggtttaagtatttgaataagttgcacttacactatattttgtttcttgtacctttgtttgactactaacttgtttgtgaaagtaaagtggcattatttggacttagcttgagcatattgcaaaccattttgaaatgaagtgataaatgtatgattctagctcttagtcaattatttttgttgctaactatatttgtctaaataataggaatcattaaaaagagagtaaaaaagaagtgaaggggtttggctcaaaagagccaaacttgggctagactggatttcaccggacggtccgcgtgcgttgggttcacgatagactccgtgttgtgcgtggaggtttctcgctactgttgggagatcgtggggcgtcagagcacgatgagtctggagtagaccccgcgttgtgcgtggagggttcgtgcagtcgttgggaaacgataaacccaatggacgagacaccagggatgccgcatggctgagcgaagcctgttgtgtgcgtacgtactacggatagatgaaaaagagaaccgcatgttagtttataaagaaatatgaggatgtttttttaaaatatgacgcagaactactatcgaaattgatactttaatataataaaaaataatattacgtcatgacattttgtatactgtgatatttttaaaaatgtgttccgaaacactccttaatgatggcaaccaaacatgttctacataaataaccctgatcaacggttcactctcgctcatgtaagttttagaacaattcgtgttgaatgtttgtaggaatcctgattttaaaatatgttaaattttgtacgaggcacgtttactaatgatataggtggtgcttacaggtgtggattttccggagcacacaaatctccatggccaagtttgattttctcccatctttaggtacgttccacaagagggacgtgccatcctcagcctcaacgcggctggaacgatcgatcaaacgagacagacaggctccccgctcccgactgctgcctgcgacgactcgcccgaccggacccttccaaccaagccggtgacggtgaggacgcctggcaagctcgcccgtccacgtgtccccttttcgaggccgccatctcgcccccgcgcttttgtgcgtcagccgccgcgcagcccaacacccgcatcaaaacacgcacctcggctcctcccctccccaccaggcaccaaggtcgccaccgccaccgctgccccaaagtatcgcacccccaaagccccgctccctcaccttctggaaccttcctcgcatggccccgcccccctccatgcctgccgcctccgatcgcgccggccctggccgcgacgcgggcgactcgtcctcccttcgcctccgccgcgccccctcagccgacgccggcgaccttgccggcgattcctcggtaggcttgcgggagaacggcgagccgcaaccgccgacgaatccgccgccgcaggagcagcagcagcagcacgagatgctatactaccgcgcgtcggcgcccgcccaccgccgcgtcaaggagagccccctcagctctgacgccatcttccggcaggtgaggagacgcgaattttaggctcgctgtttgtaagcgattgtttgatccccgcgcttgtgcttcgatccacgccagttgcaaaatcctgcaaattgtttgttgcttccagtcaactctgcctctgtttttttttggttggtgtgtgtgtgtgtgtgtgtgttcaaatcacactttgtgctatcggtagcttaacactgccggttgccatctcgcgcgcacggatgttttattgtgggccttgggcttcggaattgtggatagattgtgcgcgtgtactcgaatgggcacaattcgtttcgtggggggcatatgctgctgcgattgaggtcggtgtttacttgttttgggatcagggggaccagtgccggtgcgcgggtgccagatgcatgccacgcagaatttggcatcggccggctgaagcagcaaacaacgagcgtaaccgttaccactggaggagctttggcttgtcgaaacggatgactggatgagcgaatgaatcattgaattcattgttggcggtactcactatagtgatgtggacagttgttgggacagcacctgcagtgcccccagtattattaatgctgacttttctaactacaatgcgtgttacattgtttgtacaccttggctttcctgcttggggcattgcttcttgttgaggaccatataactgtgcacctacatagaactgtattggaccacttgtaagttttaactggttagccctccattttttaataggtatattattagacaatttttattgtcattgacattatttttgtttgctactctcggagcccttttcccagtgtaatcttaatagggctcaaatcacagcagaaacacgtgagacgtaattttctagtgatacttttattagactttgttgtttctgcacatactctaaatctgttttgaaggtaggagtgcttatttggatgataaataatcctctgttagttgcatgaatatttatacatcacatgcctcctacatggttcctgggattacacagtggacaacgctttgataattgagtccatgctaacttgattataatatatcagtattccatatatcattttatcttgtacttcaactgagatcatccttattttttgcaaaccgtatttattggttgctctggagaattgaagtcttgaaactaagcacttctcctgattgcagagccatgctggtcttctgaatctatgcattgttgttctgatcgcagtgaacagcagactcattattgagaatttaatgaaggtttattactttctttcttttttcattttcctcaccttcatttacagatccctcaatccatctccttctgaaatacatctggtcttcttcctgcgcatttgtctagtgtaaatctgacacattctgtgttttatttaaattggctggtgcagtatggcctgttgataagagctggattttggtttagtgcaagatcgctgggtgactggccccttctaatgtgctggtagaaattgttgtcatttttaattcagatgggtttcaaataagaactgtggagtaatcaatctgtcaatttcagcctcactctaccagttttcccactagttgcactcatggctgagaagctgatcacaagaaagctcattggtgaacatgtaagtttgactcacaagattgcgtagtattttgtagagaagttctcttttgttatttcttaggtataagtgttgaggattgaattagatgtaaaactagacagtcctctattctgcatcttccaggtgccatttatcgtttatgacttctatacacctcttgcaggtggttattctactccatatcattattacaacatctgccattgtctatccagttgttgtgactcttaagtaagcatttctttctgctttgcagtttgtttggatgcatcttattttgacattcgttgagctctagtatttcatggtatggaatacattcaattaatcttgttcgtaatttgctgtacttcatggtatggtggccaactacattattgtgccccaaacatttagtctttcccttcaagatacgtactatactatgcaaattgggtggataaaaaggtagctacataacacttttatttaattgtatctggtgactccacactataatacaaagaaacgcaactctccagcatattcaagaaaaaaatgtatctggtgataaaaatctattgcaaatgttcatttatctctagtagaagaaatccttactatcttactctgtcttgatctgttcactgactgcatctaatagggaagatttgttagtccatcaatattgatacacattttattatgcagatattttgtttctttcatgtagcttctagcttgtaacccctttcctaacatgaagctgatctttccattgtacaagaaaaattggatatatttgttcacatgcttggaaattgaataaacaaactgtagtatttctgatgttgatgtgcaagtagtagactttggttgagtcaattgttatctctcaaaaagagccattaggagcaagttaccttttcattgattatattttctgtgagactgcaagagttaagaatgttgtatggttgatgccttatgctgtttagtttaagtttgttataattgccaagaaatgttacttgaaaagatattgtcccatgcatcaattatggattatcagttcagtcatattccgaaaaatttcaggtgtgactcagcagtactatctggatttgtgctaatgtttcttgcgagcatcatgtggatgaagcttgtctcttatgcacatacaaattatgatataagggtattgtccaaaagtactgagaaggtaatgcattgacatgttaatctgaatcagttcaaatattttgttaacatgttgcccatttctcaaaattgatttgttgacgttcaaacttttcttaaaactccttttggtggccaaatttttctgaagctagaatatctcccacttgtttaaacttcttttccagtttcatttcatgaatgtcttatatctagtttcaatttttgcataggatgaaatgtggtgccaatcaatatacgttaccatcaagagagtaaaaaaattgttcttaacttctcatacagtgtttttgttacatgggctgatcatatatactctcatgtgttagcttaactgttagtgtatacctctattgtaatgggccttggtccacctaaccctgttatatcaatgcattcccaaccctaattagggttagggtttccctcattctaacttcaggcaacggtagcatatgattatatcccttcattttcatttttcatgcaaataaccactattgctatattcttatttttagggtgctgcatatggaaattatgtcgatcctgagaatatgaaagatccaacctttaaaagtctagtgtacttcatgttggccccaacactttgttaccaggtactattattggaccaatgccccgtttttgtttttaatgtctacactctgcttttcttcatcgcgtctatctagttatgccagtgacaacatgaatttcctgatgtcactttggcatgttatgcagccaacttatcctcaaactacatgtattagaaagggttgggtgacccagcaactcataaagtgcgtggtttttacaggcttgatgggcttcataattgagcaagtgagcctcctatattccttaagtaacttgtatttatacataactttggattaaattaccaatttttcttctattttgcagtatataaacccaattgtgaagaattccaaacatccactgaaagggaattttttgaatgctatagaaagagtcttaaaactctcagtgccaacattatatgtatggctttgcatgttctattgcttttttcatttatggttagtatcttgcttcagttcaacagtaccttaaatttgtgcggcagtgattggtttatataacaggttaattgggttttgacctgcatgggactttgatttccattttccatggcattcttgtttgctcttttggttggtttcaggctgaacattgtagctgaactcctctgtttcggtgaccgtgaattctataaggactggtggaatgccaaaactgttgaagaggtgagatgcctgttaaaattgagttcgtttcttttgaagtgagaactttaaataggactgacatcaattatattctcatgtacttaaatgtgatggtattttggggctttacctcagtactggaggatgtggaacatggtaatctttttgttacttctatattcagattctatacccttttatttagttgagactttgttacttaactaaggacagttgtgatggtagtggtactcttctatttagttaagacttccttaacttctgtcactgagcttgagatatttgtctaataatatctttcaaataactgacaattagtctattttttgtcagcctgttcataagtggatcatcagacacatatattttccatgtataaggaaaggcttttccagggtaattgcttctatatgtgtacaaaactctacatttgttctttgcttttgaattctccaaatgcagtttagtttggaacatcgatgcaatatagaattcacaatatacaaatgatgttctttagaaaatggggaagcagagctggacagagtgttagcactcaattgtcaatttgtcataataataatgaatacaactgaacaagtggctgaaactgttgtgagaaaatcagaacactagtggtcaatattatttgcatagtaaatcaatttggtaatgtaaattaagatatgaagttcttacttcttatataaagatttactatgcttgaattttatagtggctgaaactttactgttcttggataaagattttaaataaaaacaaaggatatctagacttggcaacaaaatgctgccttctgctgactggcaaaagtaaattagacaatgtgaatacatggacatacataaaattttgttggtcctttcatttttgcagaactgacatgattttcactgcctacttctcaaattcgtattgtatctacactgcagggtgtagctattctaatctcgtttctggtttcagctgtattccatgaggtactttaagttcttcagaagcctttttcatgatcggttcaatttctgtttttcctaagacatgctattgttcgaattccactcagcacattactaacaatacgtttgaccttacgtaccaatatatcatcaccacatctctttttacattgtgaattcacagatatgtattgcggtgccgtgccacattttcaaattctgggcattttctgggatcatgtttcaggtatagaaataacactaatatataactactacctccattccgaattataagtctttctggcttggcttttctagttacattatactaggtatatatctagattataatagttatatatctagacattgtgtatatctagatgcataccaaatgttacctatctagaaaataggatcatggtttcaggtatagaagtagtaataatataataactactacctccatttcgaactgtaagtcattatgacttggcttttatagataatgctaagagttatatatctggacattatctagatgcgtagctacgaatctaggaaaactagaacgacttgtaattatccctgccttttcttttgagtccatcagtgtctattctcttacgttttgattccatcattacatccataagaacaatactacatcttggatacaatgtaccttccactgttttcacataggctgacactggttgatgtctgactcacagataccgttggtattcttgacaagatatctccatgctacgttcaagcatgtaatggtacgctgtgtcaattatgtcctttttttcccattacctcttgccactacctaaccatcatcttcttatttggcaggtgggcaacatgatattttggttcttcagtatagtcggacagccgatgtgtgtccttctatactaccatgacgtcatgaacaggcaggcccaggcaagtagatagttcggcagagacatgtacttcaacatcgaccatcagaagcagactggagcgacgcggcaggaagcagcagtagcccctcacttgccattgtttaccatcagctagcagctggtcagcctgaaaatgcttctattccaggcggccgtgctgggatgcagcgtgtacattaccagcgatgcaacgtcaacggttaccaagcgcggataagcagtgctcgtggcatgtgaactctgtacacattgaagtctatatgtccgcggtgctgtgtgcataatgtcgtggtagatgtaatatgtacaatgtatgccacgacttaagaggtcaaaatgaggctcacgtcttgggatggagggagaacgactttcaaagaacagacatcgagactcgatgaacttgttctgagccggtaacttcttgtgaccctgtcggctgtcgcgtcgtgtaccaagagcctggttggtagggattgttgtcggcttcacaagctggaaaacagctcctaccaaaatatccatccacccggccgctcaatcatcgcagaagctgcggaattcgagctgagagaagctacgacagaagctgaaaaatgtaacttttggctatgggcgggtttgcccctgggccggcgcgggggcggagggccacggggctgccggagctaaatctgatgggtagtaaactagaaaggaacaaaactgagtaatgatgctgaagaaaactgaacaatgatgtaactaggatacggatttaaaatttcctaatacacacgtgaatcgcctagaacgcatgcactgcagctggtaattcaccatatacgaggcgaccatgcaacatggtataataaaaagtgaacaaattcattgaaacacacccatcattgagatcctggactcgatccaacaaagtgatatctgaacaaaggttactcaaaagcttcccgtgaggaaaaaaaaactcatgaacttggacatgttaagaaactgacatatatggctacacaacaaaattcgtgatctgatggatgtcgtacacactttcgtgtagtgaggatacacaactttggtgaaagaacacaagggcataacctttactgaggatcaggcctacatcctatcatgctaatccaattaattaatcaccatacattcatatgttacacgagaccctcatttggggtcgacagccactcactgcaccaatcatccaagacacactgctctcaagaacggcaaaacccgactttgcccttgcagccgtcatgacgggggaggattgatcttgcactaggagcaagatctgagttgagttctcttgcctccaccctcgtatatctgctagaaactcttcagtacaggtgaaaacactttacagag

SEQ ID NO: 698 - protein, 494 aa, Zea mays
MAPPPSMPAASDRAGPGRDAGDSSSLRLRRAPSADAGDLAGDSSGGLRENGEPQSPTNPPPQEQQQHEMLYYRASAPAHRRVKESPLSSDAIFRQSHAGLLNLCIVVLIAVNSRLIIENLMKYGLLIRAGFWFSARSLGDWPLLMCCLTLPVFPLVALMAEKLITRKLIGEHVVILLHIIITTSAIVYPVVVTLKCDSAVLSGFVLMFLASIMWMKLVSYAHTNYDIRVLSKSTEKGAAYGNYVDPENMKDPTFKSLVYFMLAPTLCYQPTYPQTTCIRKGWVTQQLIKCVVFTGLMGFIIEQYINPIVKNSKHPLKGNFLNAIERVLKLSVPTLYVWLCMFYCFFHLWLNIVAELLCFGDREFYKDWWNAKTVEEYWRMWNMPVHKWIIRHIYFPCIRKGFSRGVAILISFLVSAVFHEICIAVPCHIFKFWAFSGIMFQIPLVFLTRYLHATFKHVMVGNMIFWFFFSIVGQPMCVLLYYHDVMNRQAQASR

SEQ ID NO: 699 - DNA, 3127 bp, Zea mays
gcctgaagcagaaaaaaactgaaagaaacatgacagataattccctcggagaaacttggcatgtttcccgttggtcatgtaggacgacgataatgataaattggtaagcaaagaaaaaggctactaagctcgagcagtagaagctacctagctcgtcgtaacgaagaaacttctcgtccttcaggtagacccttgcttgtttgcagtactttagttagggttcggtctttaattcttttgctgggcagcagtaaacggagatgagaagcgcgagctgatcattgttgccattctgtgcaacgaagctaggggaccaatgctgactcgcacgagggcatagttgctgatggtcatagacgacgcgttcacttaaaataataaagaattataaattgttgtcataagtcgtgcagcctaatataggagagtgcggcattgctgtagctaattaagagagtattccggtcatgcttgagcttggagaatttttgagggtccgttcgcttggagagtcggagatttttgagggcccgttcgcttgcacaataataaacaaagatttgttctagctcatccaaatctatataaattaaagaagtaattcggttaggaatcaatccagagctctaattcttaaaaaccgaacagggcctgagttgtttgtctagacgacattatctgattaagttattttcatcttcaatttcaaatgtgatctagcggcataaaacttgttgtctgacagatatttgacttccacacgggccacagctcaattacaaacatacttcaaacatcaggcagaggcagagcactagcagcattcgctacgtggcggtgggcagcagtggccagcacattcgacaactgccacggatcccgtactacttcaaacacgtatcgcttccagaatccagagtcacacgtgtgcagctgcatgaacccagctcactcccttaagaacagctcgacgctcacctgtctagtctagctcgtgcatgccgccctgagcgccactgcacagacgcgcagagacagacattgcgactttgcgagagacaaaacctcccagataacgcccgcgcgctccccgatggcgtcgtcgtgccagaacgtggagattcccggcaagccgacggagacggggacggcgctgctggagacggcgacgggcaccatccaggggttcgcgccgctgagccagatccaccagcacctgtgcgcgttccacttctacgcggacgacatggggcggcaggtggaggcgcaccacttctgcgcgcacctgaacgaggacgtgcggcagtgcctcatcttcgacgggcccggcgccggcgcgcgcctcatcggcgtggagtacatcgtctccgagacggtgttcctgacgctgcccgacgccgagaagccgctgtggcacacgcacgagttcgaggtgaagggcggggtgctgttcatgccgggggtgcccggcgtggtggagcgccgggacctggagaaggtgtgcaagacctacggcaagaccatccacttctggcaggtggaccgcggcgacgcgctcccgctcggcctcccgcagatcatgatggtgctcacccgcgagggccagcttcggcaggacctcgctgactgtacggcgtgctcgcagattgagtatctgtgatctctctctgatctctctttttttactgatggatttgaacctgcaatgtacgtgcaggtgtggagaagaagttcggtgtctccttccagaaggagagggagaaccgggcgtacatgagcggaccggagcatggtatccacccgctagcgaacgctaccggcaagggcctgaggaccgagatccgtgaggtcgatttgccggcgagtactaccgccggcgccgggagggtcttcacttgatcgccgtatcgtgtgttgccgcggcgggtctgcgtaatgtagactatatagacggtgcttggtttggtctgtagttcgtgagtacgtgctcaatcgtttgtgttctcttaagacacgaactactgttcatatgaactttgaattttcgcataataagagatggcgctctactaataatttgtgtcaaaaccgttttggttgaactcttggatttaggatgggataatgaatttcatacagtttgcatatattaatgccaaatatctcctagaaacttgtccttaaaatgataccaattggtgaatgggaaggtaaacatcttcacaagatgttttaaaatagtcccccaaatattaagacactacaatcatttaaattgcttattacatagttaagtcctaaatcatttattttgttatataggggaaagagggtgagtcatttattttgttatatatgggaaagagggtgaggtagaaaataaggattgtgcattaatctgtgggtgtaaattacattatacttgagaaaacgttgaggatgatggggtgtaaattacattatagaaaaacaaggatacgacactgataggacattaacccattaacctagggtgtaaattacattatatttaggtcacttttttttataaaatttgcaaaataaatattgtttttatgagtttagtagggtattgatttaaggcacaatcctcttaattagacaagggagaaagtagctagtgctttaagttctctcaatgctttaagttctctcaatttctctcaattagataagggaaatgtgctttaagttctctcaatttctctcaattagataagggaaatgttagctaagactgactgcagcggtcgaccctaccgctccccctccccttgcatgtcggctgtagggggcaccttatggccgcagcggtgcccctacaacgccccctacgtgtcggtccccttatctctcccccccagatctaacgtgtcactgttcatcaccctaaacactgtgttgtgggtccacgagtaattgttagtagataaaaaattgatagttggtatagaaaatgatattttatagtggtagtggggtatagggggagggagcaccttatggccgcagcggtgcccctacaacgccccctacatgtcggtccccttatctctccccccagatctagcgtgtcactgttcatcaccctaaacactgtgttgtg

SEQ ID NO: 700 - protein, 238 aa, Zea mays
MASSCQNVEIPGKPTETGTALLETATGTIQGFAPLSQIHQHLCAFHFYADDMGRQVEAHHFCAHLNEDVRQCLIFDGPGAGARLIGVEYIVSETVFLTLPDAEKPLWHTHEFEVKGGVLFMPGVPGVVERRDLEKVCKTYGKTIHFWQVDRGDALPLGLPQIMMVLTREGQLRQDLADCVEKKFGVSFQKERENRAYMSGPEHGIHPLANATGKGLRTEIREVDLPASTTAGAGRVFT

SEQ ID NO: 701 - DNA, 5558 bp, Zea mays
ctattatgtaatgcttattgacctgagtaaaatgcatgtatataatgttagtttgagttcaagtgggcataaaatgctatagaaagtccatacttgtgaaaacttatttaaacctttttaaagtcggtaaagccatattttagggaagtctgagttaaagttataatttagcatggttgtgtaaatgattatgatatgtacccagggtagagatcatcccataaatataaagtgtcatcgtcgcttgatggcctcgaaccatatttgtcatcattttttatcttttaacacccttttgtcttttgtcccataacccaactttttcaactccatttgatgctcttcttcatctgcatagcataagaaggcatcctagttggtgtattgagcctagggcacataggcatgcaagtgctcaaagtgggacccctctcaggcgagcgttcgatgattctactgtcaaaactggctaagttggtttctaaatctgacttagctagaattcatagaggagccacaaaggtgtgtatgtgagagttgcatgagtgtgctcatgtgatggcgtgttctagcatcgaccgtaactgatgtgattgtcacttttgtttgtttttcatgtaggaaaggggaaacatatgtgcaagatgagaagcttgtagtgtaagatgagtgtgagcactgcaccattgattttgtcatgattgtcaagttctccaccgtttttgttgtatgtgaacagaagagaagacttgcaagtcatctaggtgggcacaacatccataagaccatgactccatgtgtgccatgcatgtgtcatcaactaacagacgcgcactgcatgtttgcttgcaaagaaatctggcaccgtttccaccacaccatctactagctggctctccatctgtctagtctctagcccactttttgtacattagtccctcacaccatacatccatcttgctcactcctttttctctctataaacaactaaaggaggcatctctcacatcatcatcatatctctttaccccttcttcccagcgacaagagaaaggttagcacaacatcgagcccatcctatgtactttgtgatccttcttggtgttgtgatacaagtttggttgatagatatgttgattttaagaaattttgattgctttacttgctagaatcgatcgatcctttacatgataggcgggtgtatatatgtaagtgcttgttcatggatctatgctatatttgctataggattagaaaaaggaaagatccatggacatgatctccggcagcactgcagcaacatcaacaccccacaacaaccaacaggtaaattggtgatcgtatccttgcgttcgatcctccctttcatgtttgctactttcttcccatatatagattgatgtgtaggtgttgctcatacatatttgttaacctttatatatgtttttccttcttcaattgatgatgcaagtccatttctttctcttgatttcaggtagctagctcattggtagaattaagacgtacacatatattggtacatatgcaagtactcattagatagtgcatgaatattctacatgaatcaggcaatggattagcttccaaattaattcaaagctccctacaattttcaatttatttcaactataattatttaattataacatgcataattaacaagtatctaaaatttatttaaaacatagctatcaatgcatttttggtgtgataggatctttacaccatgtatcttcttcccttactttggtgaccctaatgagattaaggttcagggttggtgctacctatagtcatgtgaggcttgagggaaatcctatggtggtagagtggtggaggaggatgcgataggctaagggctacgagattacaacattaccacatccccaaaaaagccaaattagtatcatgatagatgtagcaatgataaggatccaccaaagattaataagggcgttagagtgaaagtataaaggcatggtggagaaggtgaataaggcactgttggtggggttagggggactaagtttgagagtgtaaggtggtcgattggtatcagatgcgatgcatatgagacacaaacattagcatatcgagcatggtgatctagaatgttagggtgacacccatcatctatcttaggtgagctggtagtatgggacacaagagtgtgttgggtatggtagtgatggaaacatgggtgacaagtaggttctgatttatggatttaggcttaaatagggtagtaaaatgaggcaatgaaccacactgattggtggcttaatatttaggtgttaggcttcctaatgccgagtaggtaatgtatatggtccctatgagacgatgagattggtcaagacaaagtagggaaatgggccaatgatagttatcccatggattgacagttatacaatttactagggatagagaggatgaggcatgttggagtgactaatttgtgttgaaagcaatgcaagtgagacacatacatgggaaaatcaaagatggggcttaagtgcactagggtgtttatcagtatctaatgccaatgagcaaggaattggcactagtgtagggctagatgaggcaatagtgtgttaggtatggtaatggtgacaccatagataactataggggaggtgtaaaggatgtgacccagtttgtgattagggttaaatggggttgcaaatggattattgaattaaattgattggtgtccaaagattttggtgctaggtttcatgaactatacaagtgggctagggatataggctctatgggatgatgagaccagggaaggcaaaagtgtgacctataaatacacattctattttggtgtgtcatacatacatatggaatggaacacaatatacttatctaccctaaaaaggtaagattgtgctcatcactaggggtgcaaacaaattgaatacaaatggataccactgatactatacatgtagtatcaactatgtcagtttatatactaatggatattgacatcataaatatgtgatttgattattcgtatatggatacaatatcgaatgttgaaatagccaaacttgaacatggacgaatctaaactcttctaaatggatttagactcagatacatcaaaaagtatatgtaccatttgcatccatagtcatcacacattctattcactatagaaaattaccgctttatttccatctaaaaaggtagtacacatttcatcctatggttttgaacaagtttatgcttcatgattatttaatctgttaaaacactaagttaggtgataagtgtaatactatagaattatttttctttgcttatggagataataatggctctcacacacataaataatttgtgcatccataatgtatttggtgtaggcggtgatgttgtcatcccccattataaaggaggaagctagggacccaaagcagacacgagccatgccccaaataggtggcagtggggagcgtaagccgaggccgcaactacctgaggcgctcaagtgcccacgctgcgactccaacaacaccaagttttgctactacaacaattatagcatgtcacaaccacgctacttttgcaaggcttgccgccgctattggacacatggtggtaccctccgcaatgtccccattggtggtgggtgtcgcaagaacaaacatgcctctagatttgtcttgggctctcacacctcatcgtcctcatctgctacctatgcaccattatcccctagcaccaacgctagctctagcaatatgagcatcaacaaacatatgatgatggtgcctaacatgacgatgcctaccccaacgacaatgggcttattccctaatgtgctcccaacacttatgccgacaggtggaggcgggggctttgacttcactatggacaaccaacatagatcattgtccttcacaccaatgtctctacctagccaggggccagtgcctatgctggctgcaggagggagtgaggcaacaccgtctttcctagagatgctgagaggagggatttttcatggtagtagtagctataacacaagtctcacgatgagtggtggcaacaatggaatggacaagccattttcgctgccatcatatggtgcaatgtgcacaaatgggttgagtggctcaaccactaatgatgccagacaactggtggggcctcagcaggataacaaggccatcatgaagagcagtaataacaacaatggtgtatcattgttgaacctctactggaacaagcacaacaacaacaacaacaacaacaacaacaacaacaacaacaagggacaataaggttagtgtgccagaccgtggaagcgttgctgctataaataatgcaattgggtagtagtacccagtgaaatcaggagagactagtagcctagggtgcattttgatttatttagttttggtcaagatgacaagtcatcatgaatcaccctttttattcatttgcatgttttgatgagagttcatttgcagtaagctatatatcattggataattaatcatttggttggatcatcagttcctatgggcattttcttcattttttctattctttaatttattaactaatgtatagcttttccaacttaactacttaatttggatagatgaagcatgttgtttaacatgaattatggtagccagaaccgtatctatatactattggtaataacaatttgttgttgcatatgtatcttttgaatgttttattccttttgtttcaactttcaatgagaaaatttaacaaccttagttatatgaggctatgcatggacctcttattgtcttacatatgtgcatgaaacacaacaactacttgcttcatatatactatagtctacatgtcacacacaagtatgcatgtatatatagtatatggcacacacaatttacacatttccacaaggtgacatatgtgtagaaagaggatccacatgttatatgattcatcagatattattaaaagtatagaatataatattggaaattaactaaaagaatggactactagttaggaaagtcgcaagttgagtagcgatggggcacatgtcttggcttcccaagaaaatacaatacactggcaactgtcatggccatgagatgcttcgttggattccaactcctactaggccttgcattcatgtttccatccttgtatatagtatgaaaaggcaataaaggcacacatcttttactttgtagctatgtcattgctatatcattgtacatacaacacctacaacctgatgtaaaagtgacacacacacacacacacaaatgcaaatcaatcttgagctgcattgtcaactatggacttgtttgacatagctctacgtgagatctaggttggatatctagtctgaagcaaaaataaagtggtttacgtatttgtggttgtggtcaatctatatttaaacataatggtttatttaaaagctcttatgtaccactagatgcaaattcaaaatatcacaaactaattaggttcgtagatctcataagggatgtcgacaacaa

SEQ ID NO: 702 - protein, 325 aa, Zea mays
MDMISGSTAATSTPHNNQQAVMLSSPIIKEEARDPKQTRAMPQIGGSGERKPRPQLPEALKCPRCDSNNTKFCYYNNYSMSQPRYFCKACRRYWTHGGTLRNVPIGGGCRKNKHASRFVLGSHTSSSSSATYAPLSPSTNASSSNMSINKHMMMVPNMTMPTPTTMGLFPNVLPTLMPTGGGGGFDFTMDNQHRSLSFTPMSLPSQGPVPMLAAGGSEATPSFLEMLRGGIFHGSSSYNTSLTMSGGNNGMDKPFSLPSYGAMCTNGLSGSTTNDARQLVGPQQDNKAIMKSSNNNNGVSLLNLYWNKHNNNNNNNNNNNNNKGQ

SEQ ID NO: 703 - DNA, 4870 bp, Zea mays
gggagccggggcgcgggtgtgaactgcggtgggcgcgtcgacgggatgagcggccatcgcgtggggagcgggcgtggtttgggggctgggggcgtcacggggcggagttagggagcagaggcggcggtcacggcgccaaggctgcgtggcgagcaggcaggggattgtgcggaggcctgatggcggctacgacgcgataggttttcgggaagctgagcgctgcgggatgcgcggggtcgggcgggggcatggtgatgctgtggacgccctcgcaccacccttaaggattagtagagatatatgtgcacatttgttatataaggaagctagagcggagaagtgtgcagcctgttggctaattaataagtgataagaaaggttataaattgatagtaagcatcgtttattggataactagtctagattaattgctccaaaatatagcaagtcacagtgaaaaaaacaaaaacctaaaactacgtacatatatatatatatagcatgtaagctgagatttctgtttatgctttcctttcgtttaatttggacagcagattacttgtacgcatatattgtcattatcacgataaaaaagtaaagatcgtgtaccctttttgtgtttcttgcacgtagttcgtcgtccacatgaacctcaaagttgtgtaggtagaacagaaagtgcaatacaatacatgttgacgttggtaaggcatggtgtctagcacacaaagccagtgcaaaactcgttatccaatccagtggtttaaaggtagtagaacacacacgggcatgcatgggtacacgcttggcttattgctaacacgtgtggttaaaacaaaaacacacatgcatgtagcgtcacgataaaacccatggtacgtaacttggtagcgcaccatctagctaactttgctttctgttagcctttccaaacaaaatcacttgtcctatttgctgccctgcaggttcacattgagtgcaaggccgatgcatttttttcttctttttttttgcctctccagaagtttctgcagggaggcacagcaagagagagagcccagcactagataagtagggggggaaagaagagcatccaagcgtactcctcgatctccttcaagcagctaacataattaactcatgggtgcatagagatatgccgccgacgacccatcatatctatgggtccctccccttgcactgcatctccttcaattcctagtgtttgcttctccctttcttgacctttgcttggaaccattgattgatagttacttattattgggcatggagcacgtcatctcaatggaggagatcctcgggcccttctgggagctgctaccaccgccagcgccagagccagagccagagcgagagcagcctccggtaaccggcatcgtcgtcggcagtgtcatagacgttgctgctgctggtcacggtcatggtggcggcgacatgatggatcagcagcacgccacagagtggacctttgagaggttactggaagaggaggctctgacgacaagcacaccgccgccggtggtggtggtgccgaactcttgttgctcaggcgccctaaatgttgaccggccgccggtgatggaagaggcggtaatgatggcgcctgcggcggtgagtagtgccgtagtaggggaccccatggagtacaatgccatactgaggaggaagctggaggaggacctcgaggccttcaaaatgtggagggtatatacactgctcgctcttcttccctatctttattattccctcgctatatcttcggcggtttactcgtcttttatctcttattttacacttcattgttgtataaatagtacaaaacaatgttttacacggcctgtactgtactctctatgggctacagggtttgtagtagtacgtgtgtcttattaactgggggtgcaataactgaaatcggccggtgccttttctgacgtactaagtttgtatcacctacatctagtgcatccaaacacaccttctaaaagtgatgagggtaggtaatccatgatctagctatagagatgtggtgttctcgttgagctatatgccatgtttggctatacaaactgccaaacaaggatgccacatcacaagtcactgtgcttagcttgttctgtatatatgtatatagcgctagctagtgtcacgagatttgtgatgttggatttagcttactaggttttacaccacgagtcatgtaaaacctagtaaactaaatccaacatcacaaaacctagtaagctaaatacaaactagcaatccattcttagcttactagttttttttcaaaaaaaactacgatagccactcgatctttacaaacttttatttgttgaattttaaaacttgaaattttggcatatatacccatccacaggcggcctccagtgttgtgacctcagatcaacgttctcaaggctcaaacaatcacactggaggtactatatctactatatatatgtgccattattacattgtttacagacgtgcttttgtatatagatatatatcctgactctcgatctggctcacttaggtagcagcatcaggaataatccagtgcagaacaagctgatgaacggcgaagatccaatcaacaataaccacgctcaaaccgcaggccttggcgtgaggcttgctactagctcttcctcgagagatccttcaccatcagacgaagacatggacggagaagtagagattctggggttcaagatgcctaccgaggaaagagtgaggaaaaggtaattccggttgatttgcagcttattaattgtacggtttttttttactcctgggcttatcgatctgtcacttgattttaattagaaaggaatccaatagagaatcagccagacgctcgagatacaggaaagccgctcacctgaaagaactggaggaccaggtactgatgcgtagcatcacaaactaaaccatcgatcgtcgttccatttgcctactgaaaccctaaaaaaaaagggttttttaagctggtgctttccgttttgctggtgtagtcgtgttttttcgttcagttttgccgtgcttgaccattatattacaggtagcacagctaaaagccgagaattcttgcctgctgaggcgcattgccgctctgaaccagaagtacaacgacgctaacgtcgacaacagggtgctgagagcggacatggagaccctaagagctaaggtacgtaaccgcggcgttctccttattttatgcttgaacgcgtcgacgagcgagcttgcgcgcggtaatggggaggtatatatgtctggttgcatgcactcttgcaggtgaagatgggagaggactccctgaagcgggtgatagagatgagctcatcagtgccgtcgtccatgcccatctcggcgccgacccccagctccgacgctccagtgccgccgccgcctatccgagacagcatcgtcggctacttctccgccacagccgcagacgacgatgcttcggtcggcaacggtttcttgcgactgcaagctcatcaagagcctgcatccatggtcgtcggtggaactctgagcgccacagagatgaaccgagtagcagcagccacgcattgcgcgggggccatggagctcatccagacggcgatgggatccatgccgccgacctccgcctccggatctacaccgccgccgcaggattatgagctgctgggtccaaatggggccatacacatggacatgtattaggcactgcgggtttcgtgatcgctgggaacattttatttgcaggcgtcgctgaataaggctggttgtctcgatctcccttgacatgaaatccaaataactcacaattaaccatgagtgttccgtttggtcccagtttcgaaggtattgttaatcataatagtgttgttctgtacttcactccatctaccactaccggaatcagcttctttgccgtgtgtctgagacacacggcaaaggctattttacactcggcaaatgctttgccgagtgtaacactcggcaaagaacgctcggcgaactgtacatcggcaacagcatctttgccgagtactttttgtcgggcactcggcaaagactttgccgagtgccatttggcactcggcaaagaaaagtcaccgtcacggcgctaagtgacggtgacggatccttcgccgagtgcccacggcgacactcggcaaaggaggtttatttgccgagtgtcaggtggactggcactcggcaaagaaccctccagtggacccctttgccagttcctttgccgagtgccttggcagtggcactcgacaaagacatctttgccggttcccaggtttccttctttgccgagtgccattttcagcactcggcaaagacggctttaccggttcccaggttgcactcggcaaagaaccctccagtgggcccctttgccagtccctttgccgagtgccttggcagtggcactcggcaaagacatctttgccggtacccaggtttccttctttgccgagtgccattttcggcactcggcaaaggctcggattccggtagtgtacgtgcgagaccttcgtattattttcatcaaattatattttaaaaaaatcatatcaagtaaaaagctagggttattatttggatcacgggcctatttgaaagcacaccagttttttaaagcccatttttatctccagtttctaaaaactagtttatgaagaagaagatagacaaaggtgtttggagctcattttttttaaaaaaaccagtttctagttttttataggcaattactaggatacaccctctataatttaaaaagcggtgacaatagatgtaaatttcatgaaaccaacaggggcaatgatgtaattaaaca

SEQ ID NO: 704 - protein, 441 aa, Zea mays
MEHVISMEEILGPFWELLPPPAPEPEPEREQPPVTGIVVGSVIDVAAAGHGHGGGDMMDQQHATEWTFERLLEEEALTTSTPPPVVVVPNSCCSGALNVDRPPVMEEAVMMAPAAVSSAVVGDPMEYNAILRRKLEEDLEAFKMWRAASSVVTSDQRSQGSNNHTGGSSIRNNPVQNKLMNGEDPINNNHAQTAGLGVRLATSSSSRDPSPSDEDMDGEVEILGFKMPTEERVRKRKESNRESARRSRYRKAAHLKELEDQVAQLKAENSCLLRRIAALNQKYNDANVDNRVLRADMETLRAKVKMGEDSLKRVIEMSSSVPSSMPISAPTPSSDAPVPPPPIRDSIVGYFSATAADDDASVGNGFLRLQAHQEPASMVVGGTLSATEMNRVAAATHCAGAMELIQTAMGSMPPTSASGSTPPPQDYELLGPNGAIHMDMY

SEQ ID NO: 705 - DNA, 5432 bp, Zea mays
gcgaaagcatcatctaatacagtatgtaatgcttgcacaccggtcgttttgtttgttactagttagttacaccctgcatcggtatatagtttctatataagatatatatatatagttttttttacaacacaaaccaacatgagctgcagtggttagaggtgagtgctctctttctagggagtagagaccaccattcaaatcctgacatgcatctaagggtctccatgcgcgtcttacaaagaaatcgtagtgatgtatgggtaactaacttgcgtgtgtgtatatatataattcgtggctttaggtgatgatcgggtgaaataacttaacaaatttaagttatttatatttgttaagtcatttcagggtaggtaattatctacctagctagatgataaatagggatgcctcatatatatatatggtcgaaggttattacctatggattatgctagagatatgtcagaacaatagtgttatcaggacttgttcttggaaactttctgattcattttgaaatatatgcagatcgatgttataacaagcatcggcggctaaatgagacaggttcaaagctaaagatgcacgatggacgatgtgcgtcatatttgagacttagcttgctccatcagccaggcacatgcacatgcacgcatgaaggctggctggctggctgtgtgtttagaattgaaacacaggttcagagctcaagtacataggctgtgattctctcggatgatgcatggtggggtcggaatgaatgagaatcaaacgcatagcgactagcgaacctattcgatgcatagatgcacatgcacatgcgcgcgcgggaatgaagcaaagaatggacgagagtagctcggaatggcgtgctggccgtggggtcctgagactccctgcccgctcgtcctgcatctctctgctgcctgcatgatgatgcacggagagcagcctagctcaatgcagcagcagcagcagcagctataaataaacaggaaccagcgggtgcaactagtaacacaccactgaactgaactcccagctgtaatctatctccttgcagtaagcaagggcagcgagagtacgacgacgacggcccagcaacttcctcgaacagagaaaaaaaaaagaacagcacctaacctagggaaggcaagtggttttcagaaccctgttgcgatcttatcgcatcgtatttgctgtgctgggttaaattccacgacgatccggccttgctcaggtgactgttgcgtacatacgtaggatgtgtgtgtatgcgacgacggcgacgactatgtgagggtggcatcaaaagcggcggcgcgtgcagtttaggtagacgctgtttcccgttgacaccgcgtgccgccactgcgcgagtcggtcacgcgccccgcccgtcgtctgatgccttgcactgcactgcactgcgcgcttgcatgctcaacccaagctccccggcgcgcgcggcctcgatggcgactggtcggggcgggaccgcgggagcgggcgcgggcctttataaaatggcacgtcgtgctcgcagccaggcagccagccacgcagcaggagcagcagcagcagatctggcaggagctagtgatcactgacagtgacaggtcagggcatcgctgcctgccgtcacgtactacaagacactacggtatgggggtgcagagtgaaccgccgcttcgattctgacctgttgcctccttggacactccgcagattgacatggcggagaacaacgtcgtggccacgtactactacccgacggcagcgccggcggccatggaggtctgcggcgcggagctcggccagggcaagcccgacaagtgcttcgacgacgatggccgccccaagcgcaatggtacgtaggtttgatttcaactaattggaggtaacgatgtaggctccattcgattcgtgatgtgtctattatcctgctaatttcaatgcatagtctattttaaaatattaaactgaactctaaagtgaatgtctcttaaaaatttaaatattgtttgttcaatttatatcgatttggtacaattaatttgtatttacctctaattttctaaatatagaggaggtcaaaggagctaaaatcctcgtgctatttaaaactgaatagaaagagaatttttgtccatcaaatttcttcggtatttttgctcctaaacatgcttgagtgtttctgcgaaattggacgaaatttttttctccccgcgggaacggagaccggagtgccgctattctacgatggaaattttcccgctgcaggcgcacaccgaacaattccaatttaataaaatcggctcgctcgattgcacggcccgtaggctagcgagggaacgtccgtcgacgtgtcagcaaatcatctcgggtctaggcgtctagcggatgcacgccctgggagggaccatgattttttttcccgcttgctgccgtgttaacgttgagtgctgatgtgcattccgacgtattgggctgcatgcatgtgctacagggacgatgtggacggcgagcgcgcacatcatcacggcggtgatcggctccggggtgctctcgctggggtgggccatcgcgcagctcggctgggtggccggacccgtcgtcatgctgctcttctcgctcgtcacctactacacctcgtcgctgctcgcagactgctaccgctccggcgaccccagcaccggcaagcggaactacacctacatggacgccgtcaacgcgaacctcagtgcgtgcccctccgccttcgtccccctccttcccacgtctctgcattgcgactttgcgagagttggagacccattagctagagcttactctgtgcatcccgtggactggaatttcgtcgagcaggtggcatcaaggtccagatctgcgggttcctgcagtacgccaacatcgtgggcgtggccatcggctacaccatcgctgcctccattagcatgctgtgagtgaacgcagcctttcatctggacagtgatgcatgaatgtcgtacctcctgtgacttgatatacatatggtgtcgtgttggtgcgccgcaaccgcatgcagcgcgatcaggagggccaactgcttccaccagaagggacacggcaacccctgcaagatctccagcacgccctacatgatcatcttcggcgtggcggagatcttcttctcgcagatcccggacttcgaccagatctcctggctctccatcctcgccgccgtcatgtccttcacctactcctccattgggctcggcctgggcgtcgtccaagtcatcggtacgctgcaggcacacgccgtgacgcatgatgcctttttttttcgctctggcaaacatcaggtcatcagcaggcagtgccactaggacttaccatgagtgcgatgcaacgcagcgaacagaggcgtgcagggcagcctgaccggcatcaccatcggcgtggtgaccccgatggacaaggtgtggcgcagcctccaggcgttcggcgacgtcgccttcgcctactcctactccctcatcctgatcgagatccaggacaccatccgggcgccgccgccgtcggagtcgacggtgatgaagcgcgccacggtggtgagcgtggcggtcaccacgctcttctacatgctgtgcggctgcatggggtacgcggcgttcggcgacggcgcgcccgggaacctcctcacgggcttcggcttctacgagcccttctggctcctggacgtggccaacgccgccatcgtggtccacctggtcggcgcctaccaggtctactgccagccgctgttcgccttcgtggagaagtgggccgcgcagcggtggccggactcggcgtacatcaccggggaggtcgaggtcccgctcccgctcccggcgagccggcggcggtgctgcaaggtgaacctgttccgggcgacgtggcggacggcgttcgtcgtggccacgacggtcgtgtccatgctgctgcccttcttcaacgacgtggtgggcttcctgggcgcgctcggcttctggccgctcaccgtctacttccccgtcgagatgtacgtggtgcagaagaaggtgccgcggtggagctcccggtgggtgtgcctgcagatgctcagcctcggctgcctcgtcatctccatcgccgccgcagccgggtccatcgccggcatcgcgtccgacctcaaagtctaccgcccgttcaagtcctactgatcagattcacggcctacgggagacgcagcagcatgtggtatataggcatatactagcaaccatgttcgtgagttgcaactcataagtacttaaatcagactctgcatcattgctaaacgcgagtttttttaacttgtatacgcatgattcatgagtcccaattacatatgaaaaggatgcaacacaatatatattgaaatataaaagatctcgtaccgatagtcgctaaacatgggcttttttaattcgtataaatataagttatataaaatacgagagcataattttgaacgtaaaaaaacgtaaggaggatgaaaaaatagatcttcaatattagacatcaagatgatagaaattctcatgaaaagcactcaaatacaatacagtgtctcaccgtttgggggaaaaaatgtgatgaacagttatgacatgcggccgcttatattccatttaaatctggaaatcttgataatccagaagagcgtaacgatagtatctatcttcaacaacggaggctcatgtagtagacccggtatcaactatcattagagatggccaaacgggccgcccggctcgggcccggtgaagcctggctaaaaaccgggtcgggcctgctgagcccgcgggcttaattttctgtccaagtctggcccacagcgggcctaaacaggccgggccggcccgtttagcacgaaaaaatcgagccgaaaagcgggctaaacgggcaggtaaacacgttttagtgtaaaaaacgggcttaacgggcttaggccggaccggtttagcccgccgtgcctagtttcctgtccaagcccgcccgcttattcgtaccgtgccgggctcggaccggacctaaaaagcaggcttcgtgccgggctcactagcctcgtgcttattggccatctattcatactcaaggctaggcttgaaacttgggtgcgtgtgttgctggcatcatcagaggcccatgggccatggctccactattggatcgagccatcgaggccagcgcgattctgttgtccgtcagcatgatcgaggcttagctgagcattggcgcgttctagctgctgagcatgtggcggacctaggctctaggccttctccgttcgtggcaaatctaaccgagaatattattgagatcaatagtgttaactttactatttaatataaacttttttaaactttaacagtattttgttaaaggatttaaaaattttatcaaggtca

SEQ ID NO: 706 - protein, 494 aa, Zea mays
MAENNVVATYYYPTAAPAAMEVCGAELGQGKPDKCFDDDGRPKRNGTMWTASAHIITAVIGSGVLSLGWAIAQLGWVAGPVVMLLFSLVTYYTSSLLADCYRSGDPSTGKRNYTYMDAVNANLSGIKVQICGFLQYANIVGVAIGYTIAASISMLAIRRANCFHQKGHGNPCKISSTPYMIIFGVAEIFFSQIPDFDQISWLSILAAVMSFTYSSIGLGLGVVQVIANRGVQGSLTGITIGVVTPMDKVWRSLQAFGDVAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAYITGEVEVPLPLPASRRRCCKVNLFRATWRTAFVVATTVVSMLLPFFNDVVGFLGALGFWPLTVYFPVEMYVVQKKVPRWSSRWVCLQMLSLGCLVISIAAAAGSIAGIASDLKVYRPFKSY

SEQ ID NO: 707 - DNA, 5683 bp, Zea mays
gatttggcagtccttcggaagtttcaccggtttctttttaatttaaacgtcaaaccggttgcttttccagttttagtggttttttatttgaaaacggtttagcagactttaggtggtaatggatcaagatccaaatgttttctccaaaattaatttgagtccttaattaattttagttttaaaaaataacactcttaatcttatctaatccttaaattttatagtataaaatttagagcttattattactacccctatgcatactacgtaatgtattttacctttttttttccgttccactcatactcctacagtggtagtagctagacagcagcccttatccgaaaacttatttggccaacgaggccaagccattgttttttggcgtatgatttcccgtcattattgttttttgagtttgtgaaacttttggtctatggatttttgtgcatgcatgcatatgcgtcatggatgaggaaactttctttggcagtttacaaaactgactcgatctcactctgcatgccgccttgtagtagagtgaaaatttgactctgcatgtactccatccgtttctttttatttgtcgctggatagtgtaattttgcactatccagcgacaaataaaaagaaacggagggagtatcagtttggagcatgcagcttcagacgaccgaaaaccccatatgcaagtacaccgccaggtcagtgagccccaagccacggcactgacggcagtcggcagcagcggctcggtcagggccacggcccacgccactagccgatcgacggcgctcgccgggtgaaaaaactgcatatattttgatatttttatagttttttcaatagattctaaggccaactgcctcctccgagcaggtcgctcggtctcgctctcgccgcgcgctgcgcgtatgcgctttccctatatttcggcgccgcgcgccccctcttccctccgccgccgcaccgcgcctcgccaaaaaaaaaaaaacgttcacagccgtcttccccctcgctcgtctccaaacgaggtcgcttcactcctccaaagtccaaacccggggcattatcgcgcgtgaggtagggcgagatggcggcggcggaggaggaggaggagtgggaggatgggcgttcggtgatgccggaggaggaggacggagacatcgaggacgtcccaccgccgccgctgctaggcaggaacttcggcagcgaggacgaggacgaggacgaggcgggctcgttgaactcccagtcccagtggtggccgcggagcttccggtacgtccgcgcgtggtgcattctctacgatctcattcctgcctcgaaagccacgggcgatcttgttccgaaacgattaacaaacgatcgtgttgacatgttacatgtcgtttatgttttttcaaacacccctagggaagcgactgacacctataccattgccgcgcccccgggcctccgtcacctcgtcgtcggtgactgcaatggcctgggctctgacctgaagctgcctcttctgtcggacaagctagatgggaggcaagattcatccaacaacttgctgccagtagcagaccccttcggttcagtgctaagcgacgggagattctcagatagagtgcaacaagccccaaccactccaggatgcaatctgacgcaaaccgtgttcaatggtacagttctacccttgcaatatactgtaactgaaatgacactttcctagggttggacgtgtctcatgttttgtcttgtcgttggcaggggtcaacgtgcttgctggcattggcattttctctgctccatacacgattcgtgaggccggatgggccagccttgtggttctggcttttttcgctgtggtgtgctgctacactggagttcttctaaagtactgctttgagagcaaagatggtgtcaaaactttcccagacattggggagcttgcctttggaaggatcggccggtttctcatttctgtaagtcctggtttttgttagcatgaaatttaatttattgcacagatcttacagataagattttagaacgtgtgagcaccgagccaccacctcttctcattttaaaaatcagaaataaaacacagttggcgatttctatattcctttcatgactatctcacattacgtagataaaacagagtcgtcggcacagataaaccatatatatatcgaaatctccaagactctaaccatttgatatttgtgttttgtttgtgcagatagttctgtacaccgagctctatgtaaggaacccattttccctggcttatattgtgcataattttgtttttttattgcagtgttggtggataaacacagtactccattattttcacattcgagttatctatgatttttttactgcagtccttttgtgtggagttcgttattctggaaggtgataacctggcatcaattttcacgagcaccactttcgattggaatgggattcatgccgatggcagacatttctttgggattctatttgctcttgttgtcttacccagcgtgtggttgcgagatcttcgagtaatatcttacctttcaggtctcgctgctctcatccaacttcattttcctcgatctcgtcactgatatgataaactggttgattaacgcacctaattattccttcagtgggtggtgtgtttgcaactcttctggttttcctatctgttggtgtagttggtgctactggcaacgtagggttccacttggcagggaaagcagtgaagtgggatggtataccatttgcaattggcatttatggtttttgctacgctggacactcagtgtttccaaatatctatcagtcaatgtccgatcgcaccaaattcaacaaggcactctacatatggtatgtagataactaagtcaattcgaactgcattctggtgggagtcactcatgtggttcattaatgatttttctcaatgttatgtctaaccgtgttgttcagttttgcaatatgcacgacaatttatggcgctatagctgttattggctacctcatgtttggagataagactctctcacaaataactttgaatcttccgaaagattcatttgtggcaaaagttgcactggggaccacggtaactattattgttggtttctctgattcaattaagtgagaaccctttgtattgattcaattaagtgggaactctcattgtgctatttttttatgtttcaggtgatcattcctttcacaaagtatccttagacatcttagttatcacttctgtaacttgaggtttttaggatagcgtcgtgtttctgaaattgtctgaatcctttaggccttgttcgtttctgtcggatcggtgggtcggaacgaatcctaaccggattgcttctctaatttatataaactttgattgagtggaacgattccgggtgcaatccgacacaaacgaacaaggccttaagggatttcttcatccttaaccacttgcagatattctttggtgataaacccattggctcggagtatagaagagttgcgtccagaagggtttctaaccgatagactcttcgctgttatgctgcgtactgccattgttgcatcaactctatgtgttgcctttctcctgccattctttggtatgtaattgacgcataatgctgaaacgggagtcatgtctgcatatgtagttatcaactactgttatatgtcatacaagattttttgagttttaggacatagcctcagtctttttaactatagccaagaatgttaggcagtgggctaccactaaaaatgcacaggatacctatgcatcttcatgttttttcctggtttattatctatgtataacatgtgactgtgacttgtattgtacattccaggtcttgtgatggctctcattgggtctcttctcagtatacttgtggtatgtcgcttctcttcagtttcactgcttatctggtcatggtagtataatattaaaacaaaatgcatgaaaacaattctgtcaagccaattatagttcttattgaaacaaagctagctagattctaaaacctcgttctacataccatattcatggaaaaaatgaaaacaatgtgataattaactgaataaacacgtttcagcatcatataccaatcaaagcatctgcatgattatctgtcattttcaggcgctcataatgcctgccctgtgcttcctgaagatcgctcggaacaaagcgacgcgcttgcaggtacacacctggcattctcctcaaggacagtacatgtggacaacacatcgctaacgttccaatgtctgactgtttttcactgtgatccgttggcaccaaccaccgcaggtcatcgcaagcgtcgcgaccgtggtgctgggctccgtctgcgcagttcttgggacgtacaactctatcgccaagatagccgaaagctactagctagcaagcgtccaaaggccaagaggtctgccatggcccggccgccgcgcctgcacagggcgccatcgtgccctgtgtctaggcctcccttgtatgaactgcacggctgcaccgtgcatgcagaaacgcgaactgtactctgtctgtccgtggcccgtcccggcctgtacagggtaccatcgtgccctgtcggcctgaaataagagggtacctctgtccgtgactgtgttttctgaagacctgctgtttctgctcgcatttcagtgtatttctgtgtttctgccttggcccaggaccgtgccgtgccaacgggcggcggtcgtcggtactcggttgccgatgcttgccggcgcagtgaggagtcgcggtagtttgggcgtagccggccaatggatggcaccgggttgtttgcctaaaaatactcagctcctagaaatccacagaatttcttgtacttctgacaaacaggatctctatgcctgatagaatcgtagcacgtcaaaggctcaaagcacacccatgtacttgagagcaattagatgttctttcacatatgaaaaatatgaaaacatatatattgacgataccaacttgctactatcaatttcttaggaggatatgtcagtggactaaatttacagaaactattgacaacactgtttgacttctgagagggattatgatatttttattggacggacggagtagtatttttatggacattcagattgaaatcattaagcattattgggactcggttatttgcttcagattgttctgaatttgatcgacggaacttactgatgcagccttttgaagttacggagagaagagacgtgaatcctactgttaaacgatccgccattccgcccggacctcgttgctaaatcaagagccagcgagaaaaagtcgtactacagctgtgacgtcaagaacagagacgagaatatgtactaccgcctcgagcaagacagtcacgggattcggtcagtttagccattgctatcttcagcgagataccacccagctacaagatttcaggcattgaaacctaaactatctgagtggcacataacttatacacttatacatatctagtatttaattgtcttgtgggaattatgaaacaacttactacctctgatctcgaatatttttcattcactaattcattttttggctaaatcgcgataaataaaaaagaacgggagagtatgataatatacattggacagcgatatctacaatagtaacgta

SEQ ID NO: 708 - protein, 528 aa, Zea mays
MAAAEEEEEWEDGRSVMPEEEDGDIEDVPPPPLLGRNFGSEDEDEDEAGSLNSQSQWWPRSFREATDTYTIAAPPGLRHLVVGDCNGLGSDLKLPLLSDKLDGRQDSSNNLLPVADPFGSVLSDGRFSDRVQQAPTTPGCNLTQTVFNGVNVLAGIGIFSAPYTIREAGWASLVVLAFFAVVCCYTGVLLKYCFESKDGVKTFPDIGELAFGRIGRFLISIVLYTELYSFCVEFVILEGDNLASIFTSTTFDWNGIHADGRHFFGILFALVVLPSVWLRDLRVISYLSVGGVFATLLVFLSVGVVGATGNVGFHLAGKAVKWDGIPFAIGIYGFCYAGHSVFPNIYQSMSDRTKFNKALYICFAICTTIYGAIAVIGYLMFGDKTLSQITLNLPKDSFVAKVALGTTVIIPFTKYSLVINPLARSIEELRPEGFLTDRLFAVMLRTAIVASTLCVAFLLPFFGLVMALIGSLLSILVALIMPALCFLKIARNKATRLQVIASVATVVLGSVCAVLGTYNSIAKIAESY

SEQ ID NO: 709 - DNA, 5007 bp, Zea mays
cctctgtgttggctgaaattataattttgattacatctatacaacatatttgtattgtagcttatttccaatactaagcgtatatgatattgggatctaattaaattctatcaccttcaatatctacgtccaaacatatgttaagagatcctatataaggctggctccagcaaggaaccctaaagggttctctaccctaaatatagaggatcaaatggtcttctacgatctccagcagcgtcctctaaacggtcctctaaatttagaggacgctgctgaattctctctatatatagtttctctaaacggtcctctatccatttgaatactttaaataaccggtatagcaaaactaaaatatgtataatacatttgagagtatgacaaatacgtatgtacaaaaaataaaaataaaaaatgtctctaatatagatatttgagtatagaggacgttgttggagaggaaggagatataaaagatataatcttttaaaggagactgtaaagaacgaacatagagaatagatatagagaacgttgctggagacaacctaagaccttggactcatagggtctccggtcgagtcattatcgggattgatctctcatgtacaactctgaaaatgtcatgctgatgctgaactggaccttatatgaatccgtcttctgccaaaaaaaaaaaaatcctgaaaaacgttttactcatgacgttggcagtgtacgcttaaaagacaaaacgttttcacggatcttacatgtaaaaataacaaactgaatctaacgtgcgtaacatggaaagggattactattaagagtaacatgaaaagtgatatttgacgtggcacgcatcacacaggtcgctgcgtacttaattggacaaacatgtttggtgtttaagcaactccgttccggcctttggatcaaaaatccgtcggtaggcggcaggagctgagccctgagtgacaaaccgttgtgacactgacttgtgagcaaggggaagcacattccaattccgccaccgccacttctttcttccccgcggacgcgtcgaaaagcgagcctctggggagactcgaggccactctgccttcccctcctatcctgtgagctgtaacgcttggaggtatgtgaactatccatataagttcctgtgagctgtctcccgctcactcggtccctgtccatccgtagcgttccattccattccatcccatccccggaaagtgcaaggacgggagggagagcggccggcgcgtcacaaataccaccagcccaggggccatggccgccgcgatgaccagcttcgtcgccaagaacccgctgctcgcggccgcggcgcggcgcagggcgcctcccctcgcggggcgcgccctgccgttctctccgctcgccagcaccagggccccgcgccgcaccgtcacgtgcttcgtgccgcaggacacggcggccccggccgctcccgtgccggcgctggacgaggaggccagggccgcggcggcgcggcgcgtcgcggagaaggaggcgcggaagcggtccgagcggcggacgtacctggtggccgccgtgatgtctagcctcggagtcacgtccatggccgtcgccgccgtgtactatcgcttcagctggcaaatggaggtaaataataactctttactgtttgccttttgtagttctctctctcgttgctagtagtgctgccaggagtagagtagtatgtggccaggaggacgtgggcgcgacgcaagtgtgccaggtggttgaagcgcaatgctggacctggactactggaatttgacgcctccgtggtgaactgcagggcggcgaggtgccggtgatcgagacgctgggcacgttcgcgctctccgtcggggcggcggtacgcggcgctcctcgacgtccttttctgacgcgcatgcaagcagatcgattggggcctgctgatttcgctggtcgcgtgcgtgcaggtcgggatggagttctgggcgcggtgggcgcaccgggcgctgtggcacgcctccctgtggcacatgcacgagtcgcaccaccggccgcgcgagggccccttcgagctcaacgacgtgttcgccatcgtcaacgccgcgccggccatctccctcctcgcctacggcttcttccaccgcggcatcgtgcccggcctctgcttcggcgcggtaagctagctagctagccacggactgtgcctggttagtttagttagttggttggtcggatgacccacctctctcagcggtggtgcctgcctgcctgtcagccacgggggatccgactgtgatctcaccctccacgtgtcttcatgtcacagggcctggggattacgctgttcggcatggcctacatgttcgtccacgacggcctggtccaccgccgctttccggtcggccccatcgccgacgtgccctacttccgccgagtggctgcctcgcacaaggtacatagtacttacgacggcgacgaggccagccacctctcgctcaccgaaacttctgtagcgtgcatctactgtactgtgcctgcaactgggcaggcagtaccgacctgagctgacatgtttttctttcttttcaccgcccttttgcgcgctggctggtgtggcgtggctgggctcctcggcgatgtcgcgagcagatacaccacatggacaagttcggcggcgtcccgtatgggctcttcctgggaccaaaggtgcgcgagtggtgtggcccttcttcttttgtcctcgcattgcctgtgaatccgcgatcctctgcgactgacgtctgtggctgtggctgtggtttcaggagctggaggaggttggtggcctggacgagcttgttagcagtccggtgagtgaagctactgatactgaagacgcaggagaagaaaagacgcgtccagttgtatgcgttgtccgaacaagcgtgttcatgggccagagtgtgccaaatgagttctagctttaggcgagtgggccaaatgagtgtgggctgcgtcccagggtagtataagtactatgagtctgtaataatcaggacaagaagaatttaggtaaagtaatacatctatcgccatcttcctttcattctctcctacacgctactctcttctctgatcttctctccctcgaatcccagtagcatccagtagctaacatctggtatcactggccatctttttactgttatgcagcttgggtgtggtggattaaatcactggccgtgaatggacccatcctgcaatattcaagtcgtgcttaagaaaaggatgtcatgcttctggttgatcttgaaaagaatatcattgcaggagcagacttgagtgatttagccgtggagcattctttttgtccatctaaagaaaatggtggtcaagacggtactaaccttctcttgatttgcaactcatggctcacgagtgtcaatagcctgctcttggctaacgagaaggccagtgctgttgatgatattggctacggtcttgacaaaagggcaccagttcagtattactcacacaatctttgctcatttcacaccaggtcatcttctcagattgggagacatagcttctaaaggtacccaaccaacaactcaaggctgctgagtttctcctgtaaggccagcatcagtactgcccttgtctctcactcacccaaactatggggtaatcagtgctaatccctgaaagctgaagtagagtcatcaatcattgtctacactatcagcggcttgggggcaagccgcatttcaagcggtggggaatgttagcagtccggtgagtgaagctactgatactgaagacgcaggagaagaaaagacgcgtccagttgtatgcgttgtccgaacaagcgtgttcatgggccagagtgtgccaaatgagttctagctttaggcgagtgggccaaatgagtgtgggctgcgtcccagggtagtataagtactatgagtctgtaataatcaggacaagaagaatttaggtaaagtaatacatctatcgccatcttcctttcattctctcctacacgctactctcttctctgatcttctctccctcgaatcccagtagcatccagtagctaacagagctggaaaaggagctcgcgcgaaccagaagggccatctgatggattcgtacatggagctggaggaggttgtgagtccggcgcggcgagctcctccgcgcgctccgtggtttttgttttttgttttggtcgcttttttgttgatttcattgtcttgtttggtactggagggttggcgaatcgattttggatgcactggcgtagatgttggctgtccacttgccctgcatttcgaatggtctgggaaggcacggttcgtacatggaaaatgtcctggaattactgttgttttgtttgctgccgtcgtcacgtcggcgtctccgtggaggcgtcgcacgttctggtcccctgtattgctgttcttatcgctaggattctgtgtataacttgtacagacacgttatggatatgaaaccaccccaatgaagctaaattgggtggttggaaacagcgctgaaaattcagaaactccctgcatgctttcacattcagaagcgctggcgtgatatagagggttttcattcccacaaccccatagtacatgtctagtggagaagtatacgcttcataggctccacaaactgtatactactaagtctactggagatgtacatttctttattgccgtatatatggcgggctaattaaaatcttaataatgatctgagtggcttatttaatcaatgtaatattatcctaccgaacatcctagaaataacatacctactacacaagttccattgctagtcataatctataaaatgcaggtaatctctacatattcataaaaggcatataagcgtgacttatagtcttatatgtttcaaaccgagtggatggtttgattggatcggaggctttgatttgtgtcttagaatgttgcactttgctcttgtattgaatgcactgttgtgaaagcatggatggct

SEQ ID NO: 710 - protein, 319 aa, Zea mays
MAAAMTSFVAKNPLLAAAARRRAPPLAGRALPFSPLASTRAPRRTVTCFVPQDTAAPAAPVPALDEEARAAAARRVAEKEARKRSERRTYLVAAVMSSLGVTSMAVAAVYYRFSWQMEGGEVPVIETLGTFALSVGAAVGMEFWARWAHRALWHASLWHMHESHHRPREGPFELNDVFAIVNAAPAISLLAYGFFHRGIVPGLCFGAGLGITLFGMAYMFVHDGLVHRRFPVGPIADVPYFRRVAASHKIHHMDKFGGVPYGLFLGPKELEEVGGLDELVSSPVSEATDTEDAGEEKTRPVVCVVRTSVFMGQSVPNEF

SEQ ID NO: 711 - DNA, 3253 bp, Zea mays; identical to SEQ ID NO: 607

SEQ ID NO: 712 - protein, 241 aa, Zea mays; identical to SEQ ID NO: 608

SEQ ID NO: 713 - DNA, 4819 bp, Zea mays
aaaaaaagaaaacgaaacaaaaagatagcagaaacgataggccaaaaagtcaactatggaagctggtccacgcatacgtaaaccatgggtacgttgcagctactacgtacgtatactattgcttaagagttaagaggttggagagtaatgatgatgtgtaactgctgtacgtagcaatcccttcgcctttttggccccatccaatcaacgtcgtgggactagccatctcaatgcaggctgtagacacactatccgaatctggttcttttctgattattttttagttttttttaccgagtatgatggataaaaagtactcagtaaaaaaatcgttgctggtacaacattttttttgcgagtgttatatttagcaaagtcttcgttgaatgtttttcaggttttacggattgcttcagacactcgacaaaacaacagttttcggtaatgatagagtttaaaatataaaaaatagaaatgagtgatctgatgaagaagatagcccgacatcctatcctactcgagtgcagcaaagatcgattatacgtagccgtatcatccaccagatttacacgacacacatacgcggcgaagcttcgccgagacaacatgatcagagaagtaattaaacagatatataatagagtagaaggaataaataaacaaaaaaaggggggtgggaaccgagagaagaggaaaagcgagatcaaaaggtagctagcgagcggtccacatttcgtccctgggctgggtccagcacgttagcgatatatagagaggtcagttacagaggaggagacgccacagctacagagtcagaaagaaatgcctgtggctgtggacttgtggtggacgcggacggacctggtggtgtcatgtgttgtgtgcagcgactcgacagagagaggcggcgctgtagaaagaaagggtcttgtgtgctgcgtcctccctctatttaagggggcccttgggcgccctgttttcttcctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggtgagtcccctggtcgtccatttcattattgttgtcaactttgacgaacagcatacgccgtacgcatgcatgacgagcatatcctccggccgatcacgcgcggtggcgcctgctgttttacatgtcttttttttttgttccacgttctcctcctcagtttgctgttttactatcaccgttgattttttaaatttttttaactattcctcttgtttaaaaaataatgagttatcatattttttatttattttattatttaaggtaatttgttcttaacttaaaattttacatttttgaattaatattttaaataagacgagttatcaatgtttcgaaaaaaatcaacggtgtcatatttttttttttgtaaaatggagtaagctagcttatatgtacatcattaacttaattgcgttggtgttgctgcaggcaatggcaccgcccttgtgctcttcctctccccggtgtaagaatttatcgattctgcttctgcttgttattttttatctacaaatcaaaataataaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaaatgcgccccgcaggcccaccttcgtgggcatctggaagaagcgtgcggtggagcagtactcgccgatcccgtacgtggcgacgctgctgaactgcatgatgtgggtgctgtacgggctgccgctggtgcacccgcacagcatgctggtggtgaccatcaacggcaccggcatgctcatccagctgacctacgtggcgctcttcatcctctgctccgcgggggcggtgcgccgcagggtcgtgctcctgttcgccgccgaggtcgccttcgtcgtcgccttggccgcgctggtgctcaccctggcgcacacgcacgagcgcaggtccatgctcgtcggcatcgtctccgtcttcttcggcaccggcatgtacgctgcgccgctctcggtcatggtacgtacgttgttttcacatacatgtcgttgattctttctctctatgatatgacacgaaggtaatgtttgtttgttttcttacttacttacttacttggtgtctctgatctgctgtgtgtgtctctttttttgtatatggttgatcagaaattggtgatccagacaaagagcgtggaatacatgcccctgttcctgtccctggcctccctcgccaacagcatctgctggaccgcctacgcgctcatccgcttcgacctctacatcaccgtaagcgactattactagtataacgtgtgtgttggataaattttacattcatttttgtttaaacacctagtatgcattcgaactaccccgagccgctgtagctactactacatcatcagtgggaatctggcagtaacaagtcagggcatgcatgcttcagttagcaggtggcaaccgtagtaaacgagagagaccagtcttttagtaatacatgtagtgtgcttgggcgttggggtcgtcgtcggttgatacttgatagcaacgtcgccatcggagaacaacgtaactgaacagtgccaatcattcccattcgccctagcgagagctagcccctgcagccacctctagtccaagtccaactacacctacgacacaagccgtgttggatgcatgcacttgatgacatgacgactccaccgtccaccattctctatccggccggtctggacgtacagggtgccggctccgttctggcgccgtcgcgttggcgtccgcccgcagctacctggtgtggtggtcgatactcccaatgccggcagcagcagcgccatcagcttggattcatcaaatgcatttgcatacgtacaccagtacaaatatatcccttgggtcatcagctatcagcaggctagctaccagcagtacacttgtactcggcggccaattacagctggttcttggatcctagctagctatacagcctcagctctgctgttttctttctttctttctttctttctttctttctaaacgtacgtacgtataatgatcgtcaacgatatgatctcgcatatgcagatccccaacgggctgggcgtgctgttcgcgctgggtcagctgggcctgtacgccatgttctacaagaacaccaagcagatcatggaggcacgcaggcgcaaggccgaccagcagtcaaccatgatggaggtggtcaccgacgcctccgccacgccgcccccgccacccaacaacaacaacggcggcggcggcggcaacggctactgatcgcatgcaacaggaaggacgacgacgatcgaccagcaagcaaaagccacatacatagcgtcgtcgtagcgccccgccgcccaccgaatgcttgttgttccgattccgatctccccaaggggacgatgctccgttgcattctctgcatatcctactaatataacgaaacgaaacaaaacaaaagacagcacaaaagggcttgctgggtttcacatttaccatatataatcgtctgctgctgtcttgttgctggtatcactgctattggaaacccttcttgcttgttctctcttcattccgcccgccgcgtaggcgtagctagctgatcgatcgattttcacgtcatttattgctcggccttcttttaattttccagtttctgtatatactccctttcattttcaggatgctcagttgtaggtgaggtagtagtaagcgtttggatttttttctagtagatgaatagaaggaaacaatacccctcatctctatgctcctcgtcaccaacagcaaaaatgctatttccagttagcaacatctaaacttgtatctacaacacttgaattagttcctagactgtctcatctgaagtaacttcacaaatttcgattattttgttactctccaaaattagaacatgatagccacgtgaatgtacagggaaaagaattccaaaaacaataccatcagttgatctagattcaaatttatctttctagattttagcacagatcagtatttgcatccaaacgcacatggatgaaaaatggactatgtcttatttcattataatagtggctttagtatttgataaactttgggcttactttggtcctccaatatctcccccgttgaaatcaaatgacaaaaagaaaaaaaaaagattttaagcacatagaaaaggtcaaaaacttgtggtccttcaaaagaatttctcctttagagaaagtcctcccatttggtgaagtaatctccactaataaaaaagatatacttctctgtcgaaaaactctcctcctttttaaacaattctctacctttggaaagaattttttttcctttttttagaaaaaataaattttaaaacatgagaagatcacaaaagattttttactttattatatagactaaactcctcatgtacgcacacatatttatatgataaaagttaatctatgaatactaataagaatggaaaccatatgcatattcataagggggcaaataatatctaataattaattatagtctatataa

SEQ ID NO: 714 - protein, 261 aa, Zea mays
MVSADTIRTAIGVIGNGTALVLFLSPVPTFVGIWKKRAVEQYSPIPYVATLLNCMMWVLYGLPLVHPHSMLVVTINGTGMLIQLTYVALFILCSAGAVRRRVVLLFAAEVAFVVALAALVLTLAHTHERRSMLVGIVSVFFGTGMYAAPLSVMKLVIQTKSVEYMPLFLSLASLANSICWTAYALIRFDLYITIPNGLGVLFALGQLGLYAMFYKNTKQIMEARRRKADQQSTMMEVVTDASATPPPPPNNNNGGGGGNGY

SEQ ID NO: 715 - DNA, 9924 bp, Zea mays
aattagggttttctagggttctttttagagttttgagcactctaggatttttgtgccactcaaatccatcaaacttgataccttatgaatatttctaatgacttttgaggtattactcattttggcttcacctttatccatatgccctaatcccagggttgagtaccctaccctagagttaggaatactccaagtcactacatcccacttgttttgaagttttacctagtggatgcattctaggtgttacaaacaaaatgaaatgtcagtgcatatgatgccatgctcaagttttagtgccagtaacaccaggggtgttacaaaattttataccccaaattcagggtgttacagttctttaagattaaaatatcagacatagaatcatagtcgtctattgttcgagtagattgagcgtgagagagattgtttctccggatcgtaagcacatgcacatcaatgtgacaaactgacaagttcaagcgctcctagagcctgtttggttctatacctaagttgccaacaattgccacatttttatgacacacttttctaatgtgtctaaggttatgcgctcaaattctacgtcacaatttatcacatctaagggaatcttaccatacttttacaagtagttgacaagtgagacccaggcaggaggcgtaaaatcttgtcacaatggtggctctaaaccaaatatatgtctaatttaattaaacttatctaatcttagacgtgataaattgtcataaatgatacaatcctggcctttctgctaggagaaaaaaaacctgatggctagtttgaaaacccaaatcatcttcaggatttaatgagattagaaaggaaattagtttatttctaacctagtttctttcaatcccaaagggtatttgatgttaccaaagtaaccttgaggagaatcctgagtcccggtcctggtcccgcagccgttttggacttgtctcgtggtgtccgcgtgcacccctctcccttccttggtttcgtggcccgttaccccaccctgcttcctctccgtgggcacctgacgccgcgaccccggccccgagctggctttgccggccaatcggctcgcccgcgccgaccaccgcgcctcttcccctcgccgagatcgcctgaaaaggcaagcgaggccagcccgatccccctccccgcccccctcaagaaccaaaaaagggtgtcatttcgtcctaggatcgcagctcgagctcggtcgctctcgctcacctcgctccctactcgcctgctttccacttcctccgcgctcccgatttcctctccgattccttcgccgactcgtttcttcttggcaattcgttgcgcgggccatcgccccgacggcacctgggtacatcagctacaggacgggacaggtccctcttctaggagaggcttcgccagccgcctcccgcccccgtcactacgggcgccgtggagcggagatccatccggacttggatcggtctcgtcgcgtggtaagcatgtccagcgtgcttggatggattctagagtctatacagtagtgattggagttatcaatcaaatcctttttctcgcttcggttcagttcagttgcggatttgtccgcgtggttccgtactaatctaatccaaatgcactgttagagtaggttatctatttgtacgataaataatctgttgacacttacacgattgaacttggcacccaagtgctggtgcagtttgtttcctggggttcaattgtatccattctgatctcacccttcattttgcgtttcccaacattttggcattaatttcagattacagctcttgttttattgccagtttgagcaatatgggttggctgaccaagttttttagaggctcaacccacaatatctcggaagagcagtatcacagcaggcctgcagaagacacagcatggaatgaaccctctagctctcctgttgtgactgtaagaatatgccatgcgctactgttaacattttatgtttttgaacaatgctgtgtactggagttcctcgtacatccctacactctagttcaggataaaaggatgcaattctgtttatctagcttaggcaaaggagatgcagttggtgtgagctccaagaaaacttgtcctgttcttgttattgagaaaaacgaaagttctgatgtatacaatggatataatttttctacccaagttacttgaaaggacggtttttattttactccaattgctataaatatataccactatgtcttgtccattaaaattctccttatatggatactaatgttcgcaatgttttgatattggtcacatgaaaacaactttttttgttattgcttgtggtggttatggcaacattgatacttcaatcgctatgtacatatacaccagccaatttctgggcaactagccaactataagcttctaataaggttttagatggctccaagctaccaattgcttcaaaaataccatatgccgttgttataagcttttaagtaataagttgattatcttactgatcacatatcggcatgcaatgtaggacatcctttcagagtttaacaatgaggatattgaccgtgctatagcgctctctctatcggaagaggagcaaagaaaggaaaaggcaataggttggtatgctttcttattaatttatgctgcgacattcatccaggttcacttatgttgcctgtgatatgacattgtcaaggtacttcgtgttttagagaagcacctatgtctcatattaactggtacttaaaatgccctttgaagccaatccacagcatatgatgatagtatgatcatcgaaaatctttgttctaggatagttaacttattgctgttcattgtttttgatcttgtctaattttgatcaagaaagccgttccttttccatctttaagtggaaatagttcattctagatttctatggatttcttaggtaaatggaaacataagattacaaaaggatctactcataaggaaaccaggagttatcttatagttaattgtttcttactgcatccttgcttctatattcttttaaagacggattcaagaatgttttcttcaatttctgtggttaaatgtaacaattactaactaaatattcttatggacttcaaccaagaccatgtaagaaaagtgcatccctgaattgagcattagtgtgttacatagtagtgtattgtgttcaaaattttctctaagactattgttactcagtttacttcatgtctttagtgctgttagttttcttatgaattcatgcagttaatgtgtgacactttctggtttaatttgtttttacttctagataaggatatgcatttggaggaggatgagcaacttgcaagagctatccaggaaagtttgaatgttgagtcaccccctcgcagaaatggcagtgccaatggtggtactatgtatcatccgcctcgcgaaactggcaatgcatatcagccacctcgtgaaaatggcagtgccaatggtggaaatgcatatcacccattaccatttatgttctcatctggattcaggttcatttcaatttggttactaagtttactattatagttttgtgcaatttgagttgatggttatgaaatagtaaataagcatataactgaactaatatttttgtttccagaaaggaagtacaccactcatggaccatacatgctgcacatgttactgctaaaaaaacagcaaatcttatttttgtactattcccaccaaaagcgcctgaatattgatttatgtaattcattccctgaataccactatttgtttattggcttcacgcgaaagggcctctagatgagttggttaagtggcctgagcaccactcctcaggtcctgagttcaaatcctagtgggagcgaatttcagactgaggttaaaaaatgtcactcgctggttcccctggttgcgtgcacacgagatgaattgacctaagagctttcctgatctttctcggtcggggctccgattgagcatcttcttaatataatatcgtgggggcggtcttttccgtactggccgagtttaatggcttcacaaacactgctagtcacaacgatataatgagcctgtttggttcaacttttttctgacgagcttttctaagacctagttgtggggagtctgagtatcgtgaggattacatacagaggaagataaaagggtccatagggtttaggatctagaaagagtcgaattcctcctatcacgactacttggccaattctgtgttcacgttgatttagacaattttcaccaaagtgattctcatagaagcatgctgaaaagctggcgttatgcagtctgcatcaggcatcagcttctgttggctagaatctggttttaagctgaaacaaacggagcaattatgtcttgagtgagaactcgtcccagcagacttttgaatgggtgcggttatttcgtgttaacaaaactacctaggactttataattattttgttacgaaaatatctgtagaaattagagccgaagaggaatcaaactgtacactccacctcccaccaactgagctatgcatttcttcgttgcaaggaacagagaaaaaacgaatataggtgtctccacttttcaacaactcatgtaaagttctggccttgttttctcccactaaccaattacgttataaccacagaacaaacttggttgtcctatcaggaaaattccagctgagtttgcttatgtagtaaagaagctaaacgcatgatggcataattatttagaaaaaaaatcccacgctgctttaggtatacaactgaatttttttatctgatttgtgtagtgtgcccgttattatgccaagttcagtttccttatcttttccccagtcttcaggaaaactgttacaaactgtggtgaaatttatagctcagatgtagaatgaaagcaaatattttaaagtggacggggcttgtggttatgcgataccttatatgtaaaaggatgaagcatgtcctcaaggatgttgtttccttaaatagaagtgccttggacatgtgaaatttccaatgctatcaaaagattaagaaattgtacatatgtgaattttcaaatgctgtcaaataaacaagaaattgtgtatgatttttcacatcgattgtagtaataaagacgctgtaatgctcaagaacacaccaggatgattggcatggaagatatcattttgaccttttttctcttactatttttttatataaactaacttcttttctgcagagcatgcgcaggatgtcacagagagattggtcacgggcgttttctcagttgcatgggagctgtttggcatccggaatgttttcgttgccatgcatgtagtcaacctatatatgactatgaggtaacttttttgtttactttttagcagtttctttcaatgtactgaccttaaagccatgctgcagttctccatgtccgggaatcatccataccataaaacttgctacaaggagcagtttcacccgaaatgtgatgtctgcaagcagttcgtaaggatcactttatttaccctgaccgatctgtttatgctataagttttttctgttgaacattttacttgcctgtttgtgctaataaaatctatctccaatatcttggagaatgtgctttctctacatttttcatgattgacatgtttactcttgctaatatctgattacttcttttcagattcctacaaatatgaatggccttattgaatatagggcacatcctttctgggtacaaaaatactgtccttcacatgaaatggatggtactccgaggtgctgtagttgtgaaagaatggaggtaggccagttagcatgtttttcttaatttggtcttgtgggcatatttcatggttagaagagagcctctgtgtgtgaaatttggatcatttcattccaacatggtttgttcacttaccagccaagggaatcaaaatatgtattactggatgatggtcgtaagctctgcctggagtgccttgattccgcagtgatggatacaaacgactgccagcctttgtatcttgaaattcaggaattttacgaaggactgaatatgaaagtggaacagcaggttcctctgcttctggtcgagcgacaagctttgaatgaagccatggaaggagagaaggctgtatgtttactatgctcaaaacccaaaatttctttttctaccccactgtactgttagctgtagctattttgtttcttttggataccagggtcaccaccatcttcctgaaacaagaggactatgcttatcagaagaacagactgttagcacggtgagagtttttccaaacaccaattggattattctttccttatttaattcttgttctgttccaattttgttcttctgctgcattctgaatgagactgatgttttcagatactgagaccaagaatggctggaaacaaaattatgggaatgataacagagccatataggctgacacggcgatgtgaagtgactgcaattcttattctgtatggtctcccaaggtgaaatgtcaaccttttgttttgtataatgtcataatcagtacctcctgaccgagacaatctgctgccccagctttaatctctacgtgcacttttgccctctttcttttcactatttgccattgcccctgctttggccaagtcaacacacagttgcccctggttttgccacttttttgcaatgaaagtaggcaaaaccatagggatcagtgtgtttgagttggttaaaaaaaactcagtgggagagaaagagtgggagagaaagactgccctcacggtattatattaagaagagaccgaaatatggtcacgcccgagaaaatccctgaaccctggcttcccatcactagcgggccgtcactgcccactctgcaacgccccagccggagggtggcgcgcaggctgtaacctgggagcgggcggggcacaacgaggaaattttttttaaccaagctagaaattcgctcccaagggggattgaacccaggacctggaggtgctactcggaagccttaaccattacgctggaggcagcaagggcaatggtgcagagttaaagaaaaggggcacgcgtgcagtttagaggtcagagttgaagaaaatgggacaactaggtcagcaaagtggtttctttcagtctcttcagatgttttttccttctttgtgccctccaaaaagttgcatgagaaccgagctagtgcttaggtcgataagcaaggtgggctatgatgggtgtgtgtaggggtggtaatgggctctatgttttagattataaaatttaaggatcggatcattattaggatcggactctatttttattcatttttgaactaaaaattaattaagagattaaacaaatcgtgaagaaacatttgagttgtgatccattaccacccttaggtgtgtgtgagtagcgtgtgtgtgtgttcacatatgaaccaatgctacagctgtacccagatgcgaggcttcaaaaaaaagttgcatggaattggagatgtctggagtatgaactgactgcagacttcacgaggaaaatagtttactgttgtccatcgtcacaaatatcttctcctataccatgttgttttgtttggttctacattgttgaatcattaaggatgctcaaatttgtttgtatagacttttatggtgttttgttcttgcagattgttgacaggttcaattttagctcatgagatgatgcatgcatggttgcggcttaaaggtgatacctagttcttgtgttcttcctcggcccaaaataagggagacctatttagatctgacacagcaactaagggtgtgtttggttgtgggacagctaggacgggatcgtcccctgacgtcctctctcgtccctccaattttgagggacaacagtcaacaggggacaacacaggatagtactgtcccaacccttgacccagaaccaaacaacctaatttgagggatcgtcccgtcccatcccgtcctgtcattgcaaccaaacgcaccctaaactaatgttttagttctaggctagcaaggacattaaattgttttcaagactgaacaagtttttattagccaattctagtgaactggtggggctgccatgtaaattgttagaactcagttttggtgtcacagataattactaactagaaataagaacacaaccaatgctaatttgtcggtgaagaaaatcttgcattcatttggcaattgccataataatttgcgtacacatcctatctacttgaaactgttacaaggacatttctgctaatgaatatgtcatcacaggataccggacactgagcccagacgtagaagagggcatttgccaagttcttgctcacatgtggatcgagtcagagatcatggccggatcaggcagtagtgccgcatcgtcatcctcaggatcttcgtcatccacatcatcgaaaaagggcgggcggtcccagtttgagcacaggcttggggactttttcaagcatcagatcgagacggatacttccatggcctacggagatggtttcagaactgggaatcgagccgttcttcattacggcttgaagcgcacccttgagcatatccggctaactgggacctttccattttgaagtagcatggattcatattttgggaaagcttatattatatacatgattttcttccagagttccattacaaccaaagagataaattgtaaaaaaacattctttccagaatccagagatataatatctatgaaggccaaaatgaagtattaaatgattgagatcgatggtcagtctgcccaatcattttgtattctgatcaaactctggaatgaaacaatggcaatctttttatatggtgtcagtttcaataaataccagtaccattttacagtatatatacagttgctttcatgtgtgagcttatctcaaactacttcgtccgttccaaattataaggtgttttaggttgtgtttgttttccttttagattatataagttggattatagtcaaagtgtaggaggataaatatatcaatttgagatcacaaattgtaacacacaaaatcctaattttgggatttaaaaattaaaaaaatattatcctgaaatctaaataagagtattttcttataaaagattaaagtaaaagtatctcataaaagatattatatattagaaagtatttcctcgtaaaacaaaataagtagtaaatattgaagtttttgaatgaacttttaatttgactacatattcaaaatactttcgcagaatgaatatgatgtgtgttgcatattgaacattacctaaataaataaggtaataaataaatgaataaacttaagacatatattttgcatttatgttggagatttttttgtgcaaattagaattctatttgaatttaaacctaattggaattggaaaatatgaaataaaaaggaaaatcactcaccggccgaaacacctgtactcgtggcccacctccattccatactacaggcccagcctactgctcacggtggccgagcgctagcatgcacactgttgttatgtggggtcaccccgccagccaccttactcgcgctcatctccctctactcgctgacgcaagggccccaccagccagaagtttctccttcaccatagcaagcgcgagcagaaccgtacccgccggataagtaacgaactccaccaaacgcgcaacagacccaacaaccagtgcggtcgtgccaaaaaatatacaagagccgatgacccccctttcaatccccagctctcagaacccgtgttcgccaccagatcctcgcgccgctcgccgcctggccatggcttgtcttcaaactatggtcatgccgtggggcacaaagacgggaggtcgagatgtgaggggcgg

SEQ ID NO: 716 - protein, 508 aa, Zea mays
MGWLTKFFRGSTHNISEEQYHSRPAEDTAWNEPSSSPVVTDILSEFNNEDIDRAIALSLSEEEQRKEKAIDKDMHLEEDEQLARAIQESLNVESPPRRNGSANGGTMYHPPRETGNAYQPPRENGSANGGNAYHPLPFMFSSGFRACAGCHREIGHGRFLSCMGAVWHPECFRCHACSQPIYDYEFSMSGNHPYHKTCYKEQFHPKCDVCKQFIPTNMNGLIEYRAHPFWVQKYCPSHEMDGTPRCCSCERMEPRESKYVLLDDGRKLCLECLDSAVMDTNDCQPLYLEIQEFYEGLNMKVEQQVPLLLVERQALNEAMEGEKAGHHHLPETRGLCLSEEQTVSTILRPRMAGNKIMGMITEPYRLTRRCEVTAILILYGLPRLLTGSILAHEMMHAWLRLKGYRTLSPDVEEGICQVLAHMWIESEIMAGSGSSAASSSSGSSSSTSSKKGGRSQFEHRLGDFFKHQIETDTSMAYGDGFRTGNRAVLHYGLKRTLEHIRLTGTFPF

SEQ ID NO: 717 - DNA, 7631 bp, Zea mays
taaaattgtaatattttttgagctatttatggtcaacaataacttaagagaggttaaatgacttgacgattctatatatcgaaaaaagttgttggataaaattgatctcaatgatataagcaatgactttgtatcacaaaattttgtatcacaaaatgttagaagatatttttaatgatatcagacgagaagtaagtgtttttgactatattttacatttgttatcttataaacatcaaaacagtgtataataatttttatacgtcaaatattcgatattgtatgtataattatatatatttgtgtgtggatagaccctctatatcgaatttcgcactgggcccctgaaaagtcaggaacggccctagctatagctaactattaggtgttgtttggtttacgagacctaatgtaaatggtaacggtaatggttcccgtttgagtatagacggtaataagtttaataagtcggtatcagtttttaatgtggtatccgattacgtttgcacttaagcaaacataatttaatattatcggttacccttcacgttacaaatatgtgaaccagacaacaccttaattatgactgtttcgaatctttcactaatatgttggttaaactactagttttctgccatacccctgcaacgagtaagtgaagactgtgttaaagaataaggggcattgttgtcttctgccaagttctagctgctccgatttagctgtgctgtttaaaacatctgcagctaattttaactgctaatagttatcttaggttcgaaataccggtatatgcgtaatcaaaactcactatttttatagtaaaggttcatatactgcatttttataatgaacttaatattttctatattcttaattagaacagtggatggaccatttttgcaagtaccacaggtacgtagaagtggcctccaaaaatgctttgactattcaactaattttttcaggccaccagtccaccaggggtccacggcgcgccattagcgaaccgcgacctattcgccgtcgccaatcgccaatcgccaatctcctctccatctcgacatccgcagggcgttcgacgaaatgcgacgcaaacgccttgcggcgcgcgcccatgtggccaggcgtctcccccccgcacgctcctcctcatccggcctcgcgagcgcgcgagggagacgtcgctgtgccagcgcgaggcggacgtcacctcacctccccgccccgcgtagcttttctgacccggatgctacgctgcgtctccactactccgcctcccgccctgccgtccatgtcacgcctcggctccttcctttcgcctcccgactcctgcctgctgccccttgtcctcttccccacctcctccggaatctggccgcgcacctactcgtcgccctctcgttttcccgtctccgctttctttatcctgcgggcggagcgggtagggtggggcggtcgttgctctcggatcaagagaaagggaggaaaaaaaaacagcgctttctttctgtggccggcggttcgcccgtcgctcactggctgaagcggctgcacccgcgccctcttgctgtgtggccactggccaagcgggacacggaactcgagctccgtttggggattccggatcacttcgaggtgagcagctttgctgagttgtgaagcttttcatggtgtcttgggatttggcttagtggtgtggtactctgggtaatcgctcgggctcggaggatagggtcatcaccaatgattcggcttgtttggatagaacgccgagtccctttgttgactgaatttgtaatcaggagcccaaggattagtatccatgttgcttcgtcttgttcgtgtgaggtcaattctgagctgttcccctttgtaccgtcagctcagtaccttgtttttattgtgctctctgctctctcaccactgtactaggcgtgtctttcatgttgacaacatactgggttcacaggaatttttggcacttttatgttttgtccctcggctcttcctaaggtaagggattaaaaaggtatctttttttccaggtcacgaggtgtatgccctttgctaatactgtagtacagaaacggtgcctactgctcagtgatgaatgagatcttttcaatttgtcactgcaaaggtttctccaatttcttctggattcattctgttcttggttgcaggctaaagggattctgatcatcacttaagctcaagatcatgagttggttaaacaaaatttttaagggttcagtaaacagagtttcaaggggtcactatgatggagactggcatgaaggtcattcatctgatcacaccagagtatgtgctctgctgttgaacaaaatctaccacgtgcattccttttctactgcagctggtcatatctgttcgtataacctatgcctaaacaactaagctttaatcttacaccttttattctatagaatgcactatcctgagacaaaagaaatggcattcaatgttgcttgttctcattactgtaggatacttacgatgacagtgataatgaagatatagatcgtgccattgcattatcgctagctgaggaagatcataataagggaaagtcggtggctattggttagtgtttgcccagctattcatatcctgttacctctttgtttatgccatcattgttgaccatcttgtcccatatgatagaattcatctccttgggaacagtagctttgtaaatgaaattgatctagactacaccattgctgaattttaatgtagatactgactataatctggaggaagatgaacaacttgcacgggctctgcaggaaagcctgaatgcagagtctcctcctcgacagaatgttcctattgaggatgtgccagtgcctcaatggaatattcctgttgagcgggtgcctcctcgacagtatgttccagcaaatgaaccaaccccacatgtttacccacggggtggatccaggtacttattttttgcgctgatttatttgatattttagttgtgaaaatcatagaaatctccttctgtttcgtttccatattataaaaatggccaacattgatttgaccagaagtcctgttatgtgtataggatttgtgctggatgccaaaacccaattggccatggacgtttccttagttgtatggattcagtttggcatcctcaatgcttcagatgttttgcttgcaacaaacccatatcagagtatgaggtataagagagtgtcagagtagtatttttccatttactgttcatcgaattgatcaaccgattcatgataatgcatctttgtgcagtttgctatgcatgatgatcagccataccacaaatcctgctacaaagagttttttcatccgaaatgcgatgtttgcaacaactttgtaagtgccgacaatccaagtttatggatacgcatgaaggtattgatcagaatatatttctgatccgtctgtataactgcaattattatgtcttcttccccagattccaacaaatagagatggcctcattgaataccgagcacatcctttctggatgcagaagtactgtccttcccatgaagatgatggcactcctcggtgctgcagttgtgaacgaatggaggtcagtaaaagttttctatatctgtcaatgagtcctgtttccctgttcaattcctgattggaagccgctcagttatggttattacggcaccacgacgagccgagtcgccagccgggcacctgaacgcctaggcgaccatttattcagcagcaagtatgcaatatataccatatgatatataaaaaactagcaaataaaatatagctccaccaagtagcatgcaactatatatgtctgggaggttgccgcgcaggcgtgcagcatgggggtgggcggccggtgccggtgcgggcggcctggcggctggcggcgctagtgacggcggtagcaggggaaagaaagaaaagaaaacaagtacttctactacagtacataggcgacggcgcgtaagggtgataatgagctctaaattttatactataaaatttaaggatcggatcggatatgatcatgctctatttctatttctattcatttttaactaaaattaattaagagcccaaacaaattgtgaagaaacatttggatcgtgatccattaccacccctaatagcgtggcgtaacttggagcctgcctagtcgttgtggcatcgtctaagtcgaccaggtgcccacctaactgggtccaggcgacacgatgtgatagaccatggcgttcgttgccgagcgcctggatgcctagtcggcgcttaggcagcattgtgacaacactgcggtcagttttgactaacattttgaaaatacagctgatttgcttggaatcagtatatattactatgcgtaagagctggatagattgagtagctacatcatttagttcctatgctcttcatttttttttgctacaactctcagctgtggccgttttctgctcactgagtcacgaggtcgcgggttcgaagcagcctctccgcatttacggaggaaggcttgtgtcggtttatcccttccctagaccccacacatgtcggagcccatggcactggatctgcctttctcagctgcgaccattgcacttcagtactagttttaggatgccagcaacacagccaaattgtggtattggccaatgtcactgcatggatattttagaactgttggagccagcatatagcccagcctacaaacgtagcacctcccagttaaccgttttgcacaaatgatgacaaagttgtaagcagggtactcttcctaagcccacgcaatatgtgggagtggcaatacacgtttttttttttgcaattaacttttgtgcctttattggttctttcatttcttctgcaattattccttttcgactgtgctctttctatgacgttacaagctgccctgtgcgtctatcttcttatactccttccatcctgaaatcagccaagggagatcaagtacataacattagatgatgggaggaaactctgcttggaatgtctcaattctgcagtaatggattctccagaatgtcaacatctttacatggatattcaggaattttttgaaggtttgaacatgaaagtagaacagcaaattccattacttttggttgagaggcaggctcttaatgaagccttggaagccgagaaaaatgtaagtggcatgaactggttatttggtgcacaatacttgacatattctcttaacttatgacatttttattttgctttgtttaaggggcaccacctaccggaaaccagaggtctatgcctttctgaggagcaagttgttagaacggtgagttctttgttgcttttctctgctgatttgactactaccgcaggtaaagtataagggatggatgtactgagtgatataattcgtccagatcttaaaaagaccacagattggaccaggaaacagaatcttagatatgattataggaccatacaagctgtctcggcggtgtgaagtgactgcaatccttatattatatggtctgccaaggtaaattattttagggctagtttggcaacctaattttcccaaggaaaaatgaactaattttcttggggaaatggggttgccaaactagcccttacctttaattttttcctcgattgttttattgaggtcatcattcaaggtttctgccacttccactgtgaatgaacctttaatggatcctgaaatcgtgatgttcttatgtttgaagcatagctaggtagatctacttacttcttgtttatatgatggttacacagattacaaactggttccattcttgcccatgagatgatgcatgcatatcttcgtctcaaaggtaatttatttatgctaatacttttttgtgattcacatgtatcactatcactttctgcactaattttcttccaaaaaagattgacagttgctactgttgttgctgacatgattttctctttttaggattccgaaaccttagtattgaggttgaagaaggcatctgccaagttctatcccacctgtggttagagtcggaaatcatcgctggttctagtagcaacgttgcatccagttcagaagcatcatcatcttcgtcatcctcagctcctacctcttcaaagaagggtgcgaagaccgaattcgagaagaagcttggggcattcatcaagcaccagatcgaaacggattcttccgaggcatacggaggtggttttagagctggctatccggctgttgagcgctatggcttgaaaagaacccttgatcatatgaagttgacagggtctttcccatattaaagcaacagaagtaaaggagggggctttcttccagttgtgaggatacactccacattggaggttttggtttgggttatacataactgatatgcataccaaacgaggggaattgtctgtaaatcaggagaaccctctgctgcgcggaaacttattgcaaactgtctttttataggaaaacgatacatgcaagttttcagacagggaacttgagaggatcatatgtaatttttgggcacttgtttttgactcctttggttatcaaaaacaaggcaacataataagattgaaatttatcttcatctttaaattcatcctttctctgggaagaaagataaaggtatcatttaaattaataaggagaatgtaaataagataataagtaaaatgcattggagaaagacgtgaaacatatcatacaatcttatgaacattgcttacttccttcgacttttttcaatattaaatcaaagattacatttatacctttggttttgtgaagcttacaagacgaagaaagaattacatcttcatagataagagcatgacattgtttatctatttatatgcactcttcgaccaatagataagagcacaactttcactctttttttaaccagaagatgtctaaatgtatggcattgttcatctatttataggcacagattacatatttgataaaaatacatttacgccttcagtcatcttggcgaacgaactcttgaagacctgcttcggcttcctctagcttcatcatttgcccctttattatgctattccggagcttgtatcttcgtctgcaattgattcatctgaagatgtttttggtaagagtgattgtaacacttataaatagacaagaaaacatctagttttgtgatgttttgaggaccttcgaaaaaaaatgtccccaacagtgatgatgagctctttgcttagttctctaattcacttcccttttccgcatttacttttatcccccacgatgggcaaaacttgaacttcatttacggttgtctccaaccaaatattctatatggtcctctaacctaaatatacaaaagattttctcctctatagtttgtaacggtgtcttttaagccccgtttaaatacaaagacactctttcatcctctatatagagagactttctcctcttctctatttttttgatattttagacaatgggtttaagcaaaattaaaatttgtataaggtatttgtgggtatgacaaatacatctataccaccatataattcattagcttaattttgcaaaactcaccctaccaaatcgccccccacattca

SEQ ID NO: 718 - protein, 504 aa, Zea mays
MSWLNKIFKGSVNRVSRGHYDGDWHEGHSSDHTRDTYDDSDNEDIDRAIALSLAEEDHNKGKSVAIDTDYNLEEDEQLARALQESLNAESPPRQNVPIEDVPVPQWNIPVERVPPRQYVPANEPTPHVYPRGGSRICAGCQNPIGHGRFLSCMDSVWHPQCFRCFACNKPISEYEFAMHDDQPYHKSCYKEFFHPKCDVCNNFIPTNRDGLIEYRAHPFWMQKYCPSHEDDGTPRCCSCERMEPREIKYITLDDGRKLCLECLNSAVMDSPECQHLYMDIQEFFEGLNMKVEQQIPLLLVERQALNEALEAEKNGHHLPETRGLCLSEEQVVRTILKRPQIGPGNRILDMIIGPYKLSRRCEVTAILILYGLPRLQTGSILAHEMMHAYLRLKGFRNLSIEVEEGICQVLSHLWLESEIIAGSSSNVASSSEASSSSSSSAPTSSKKGAKTEFEKKLGAFIKHQIETDSSEAYGGGFRAGYPAVERYGLKRTLDHMKLTGSFPY

SEQ ID NO: 719 - DNA, 13579 bp, Zea mays
gccgccaagcacttgttcggtttgtgtagaacttcacgctctttcctatcccggatacttatatcattattcagatgatggtgtctagcaacaacgatagcctattatcgacttggacgaacagccatagatcttcctcaataacttacgtgccgtcgcaacgcacgtgcacctacctagtaaacatataaataagaaacactaggctcaaccgttcgaataggcatctaacgacttactccagatggccgcccgggttcgtcgacaaaatgcgacggaattctctcttttagtgttctacaaaaaaactgtatattttagataaatatttacacatgagaattactcgtaaattttcgggctccgcctgatctttctacgacatagccatcaagacctaacatgacacggattcaaatacttcaaagctagacatatgaaatgaaagcattaatttccgtaaacatgccactcagcatttgcaaaacataacaacctacacaaacaagaaacacgacatcctatctcaccagtaataaaaatttgtgccagagtaatttacaaaaatagggtcattggtttcggatgccgacaaaattgcctactaaacttggcatgccaagacgagacacgcgtgaacacttttctcccagccgagggcaagcgcccacgcaaaaacggatccggacacacgttaaagcgaagcataaaaactcacacaacacacgtggaacattctagaacatcatacacaagcaacaccggcactcatgacacatcagccaacccaactgtgcacatctcatgagctagggaacccacagttggacaaacaaaacattggacccccccaagccaaggtgacacgtccagctcttatacaggacaaccacacttcacaggaaaaaacaaggcgtgaaagaaagaaccgattttgttctgtttaaatggcatttccggagaggtgttgtgctattcatttgcgtcttgtgaagtgattctagttcagagaaagaaagaagttgagaatgagaagcaagtgaggcgcgtttgctgggaagtggttcttgtgaggtttaggagttcacccttcttttcttccccttctagaaatggagatggtcctacggtcgcagagccctctctgccttcggagtgggccggtgctcatttttcgaccaaccgtcgcgggcggaggagggggcactcaggtatgatggcgcttaatcccaagttcttgattctattaagtgatggttcgcatgagtgatctctttgatgtcatctatagaagaccgcgtcagtattcgactcgatcctcatctatttagtttcgataatcttccattttgggatcaaggcggatcggaatctcgagggtgtttgatgatcgtctccatttcttgaattttgctccttttggcttttgcccaccttaatagaagccgtctatatgcgacgcgatttaccatatatattttcctgaaactttttctaccctcttccattttttggtagtttagtacgtcatttgtttcggcccgtatgatcaaggaaatgtctcttcctttggacatctaggatagcgaggatagtttgattcacaaaagactcctccattggaggatgcataaacgttgaactagccttttgttgattgtaaacatgtagtagaatgcagcggcacaaataatcagatagtgatttggggggaattcgtatgcagtactcatcaccataggaaatccagtactttactttcgagattattcaaagagtgatttgggggaaattcgtatgttgtatattcatcaccgtaagaaataccttaagctgcagaacttaccttttccgttctgttgctgttttcagtctttgttgaggactaccagatttgcgagaagaagggtcattcgatgcgttgtagcaagtccaggtctgtggagcaattttgttgaatgctctgatttctgttctactgatgatctcatgctttctaatattgcaatatatatgcaggttgtcctaataggaaatctaggacagcgtctcccaacgtaaaagtagctgcttatagcaactatgcgccaagactcctcgttgagtcaagctccaagaagagcgaacaccatgatagcagcagacaccgtgaagaaactattgatacatacaatgggctgtcaggttctgatgcagcagaattgacaagtaatagagatgtagaaattgaagtggatttgcagcacatttctgaggaggaattgccaggaaaagtatcgattaatgcatcattaggagaaatggaaacagtggatgaagctgaggtcgaggaggataagtttgaggtagatacctcaggaattgtattgcgcaatgttgcagttcgggaagtggatccaaaggatgaacataatgctaaagatgtatttgtggtagattcgtcaggaactgcaccagataatgctgcagtggaggaagtggtagatgaagctgaggttgaagaggatatggttgatgtggatatcttgggacttgacttgaataatgcaacgatcgaggaaattgatttgatggaagaggctttactggagaacttcgacgtggattcaccaggcaatgcttctagtggtcgaacctatgggggtgtggatgagttgggtgagctgccttcaacatccgtggattgcatcgccattaacggaaaacgtagaagtttgaagcctaagcccttgccaattgtcaggttccaggaacaagaacagatagttttaagcattgttgacgaagaagggttgattgctagttcatgtgaagaaggccaaccggtggtagattacgataagcaagaggaaaactctaccgctttcgatgaacagaagcaattaactgatgatttccctgaagaaggcatatctatagttcacttccctgagccaaacaatgatattgttggatcctcaaaattcttggagcaaaaacaagaattggatggttcttataaacaagatcgatcaaccactggattgcatgaacaagatcagtctgttgttagttcacacggacaagataaatcaattgttggtgtgcctcagcaaatccagtacaatgatcaatctattgctggttctcatagacaagatcaatcaattgccggtgcacctgagcaaatccaatccgttgctggctatataaaaccaaatcaatctattgttggttcttgtaaacaacatgaattgattattcctgagcctaagaaaatcgaatccatcatcagttacaatgaaatagatcaatctattgttggttctcacaaacaagacaaatctgttgttagtgtgcctgagcaaatccaatccattgttagtcacagcaaaccaaatcaatctactgttgattcttatagacaagctgaatcaattattggtgtgcctgagaaagtccaatccatcaccagttacgataaactagaccagtccattgttggttctcttaaacaagatgagcctattattagcgtgcctgagaaaatccaatccattgtccattacactaaaccaaatcagtctattgttggcttgcccaaacaacaacaatcaattgttcatatcgttgaaccaaaacagtccatagatggtttccctaaacaagatctatcaatcgttggtatctccaatgagtttcaaacaaagcaactggctactgttgggactcatgatggattgcttatgaagggtgtggaagctaaggagacatctcaaaagactgaaggggatacacttcaggcaacgttcaatgtcgacaacttgtcacagaaacaggaaggcttaactaaagaagcagacgagataacaattattgagaaaatcaatgatgaagaccttgtgatgattgaagaacagaaaagcatagccatgaatgaagaacagacgattgttaccgaagaagacattccaatggctaaggttgagataggaattgacaaggccaaatttttacatctgctttctgaagaagagagttcatgggatgaaaatgaagtgggaataattgaggctgatgaacagtatgaagtcgatgagacatctatgtccactgaacaagatatccaggaatcacctaatgatgatttggatccacaagcactatggagtatgcttcaagagcttgctgaaaaaaattattcgctgggaaacaagttgtttacttatccagatgtattgaaagctgattcaacaattgatctctatttcaatcgtgatctatcagctgtggccaatgagcctgatgtacttatcaaaggagcattcaatgggtggaagtggagatttttcactgaaaaattgcacaagagcgagctggcaggggactggtggtgctgcaaactatacattcctaagcaggcatacagaatggactttgtgttttttaacggacacacggtatatgaaaataataacaataatgatttcgtgatacaaatagaaagcaccatggatgaaaatttatttgaggatttcttggctgaagaaaagcaacgagaacttgagaaccttgcaaatgaggaagctgaaaggaggagacaaactgatgagcagcggcgaatggaggaagaaagggccgcagataaagctgacagggtacaagccaaggttgaggtagagacgaagaagaataaattgtgcaatgtattgggtttagccagagctcctgttgataatttatggtacattgagcccatcacgactggacaagaggctactgtcagattgtattataacataaactcaagacctctagttcacagtactgagatatggatgcatggtggctataacaattggattgatggactctcttttgctgaaaggcttgttcatcatcatgacaaagattgtgattggtggtttgtagatggtatgtcatctaacacttatctgcaaattttcttatgaaatcttaacaaactctactgttagcatggtatctttaaatatagcatggatatattgatagttggttggcctaccttggagtctttaagtttgtttttactccattacaacatagataacaactgatcttttatgtgtagttgtcgtgcctgaaagaacatatgtattggactgggtttttgctgacggcccaccagggagtgcaaggaattatgacaacaatggaggacatgattttcatgctacccttccaaataacatgactgaggaagagtattggatggaagaagaacaaaggatctatacaaggcttcaacaagagaggagggaaagggaggaggctattaaaaggaaggtcagttgcaataggccctttatggttctggtgtttctgtcaaacctttagcttgaccaattgtaaataaaaaattaagttacaacaccataaatttccgataagcagtcattttgagtagttaaaaagaatctcatctccgtttgattttcttttcatagttaaacatgttatttaaaaaagtccatccatcatattaactagtctgttaagacaacagagctaaactgaccatttgggccattcatcacttcagcgttgcaagttaattgcaaactactttaaccattaacctttgatggcccagctaagtaacatcatatcttcagaataccgtttgccctgctttatgttatataaaaaaatggagcacttctctctataagatataccacctcctcgaaattttattgacagatattgtaggaattcttttagttgacttttgcttccttttgattgagcaggctgagagaaatgcaaaaatgaaagctgagatgaaggaaaagactatgagaatgttcctggtttctcagaaacacattgtttacaccgaaccacttgaaatacatgctggaactactattgatgtgctttataatccttctaatacagttctaactggaaagccagaggtttggtttcgatgttcatttaatcgttggatgtatccaggtggggtgttgccacctcagaagatggtacaagcagaaaatggttcacacctaaaagtaacaggttcgaaattcccatgttattgttcttagtattaatacctttcctagtggttcatttttctgcaattaatatagtcaagaggtgctagagcactggtcatcaagtagctcatcaagaacttcttgtcttatagattgtgatgtctaacccatatatagacatgctatttttttgaatgaaaatatagatatgatatgatcattacctatgaaactgaaacaaaaaatggcactactaaattattttagaggagctagctaatttaatgccataaaacatatgctataagttttgttttgaagttttgagaaaggttgtgacagagagaatgtagctactacaaagcattgaaggtagatccctattttgttttagaatcttacaaaaagagtttaaactgctgcatttccctaggatagttagtcaaaccttgataacatgtgttaccttttcatccatattagatcagattcatgttgaatcctggcttcttttttatatactatttctgggatattttttatattcatgcagtgagatttacttctccttgagttcccttgtaataattagatttagcacagagatgcataaaaacattttctactgcccttatctgttcttagttctcaagtagagtgctccttctccagtttacgttccacgagatgcctatatgatggactttgttttctcggagtcagaagaaggtggaatttatgataacagaaatgggttagactatcatattcctgtttttgggtcaattgcaaaggaaccacctatgcacattgtccacatcgctgttgagatggcaccaatcgcaaaggttattcatatttctgagttaaattcatattattagcgcaagatcgagtggcaactcacatcaccgtttctcgtttattgttccataacactagtattctgtctgaccaatgctatcacaggttggaggtcttggtgatgttgtcactagtctttcacgtgctgtgcaagatttaggacacaatgtggaggttattcttccaaagtacggttgcttgaatctaagcaatgtaagttaaaagtggtctacaacacccttgttgcttctatgctgtgaccactgtagtgctttgtagcgagaactgaagttgacatctctaccttaggagcaacttggtctactattctactttatatgtgtgcgcttcctcatagttcagtcactcattcctcgtgtagttggatagcttatgttaagtatgaggaatgccttggaattgttgatgtgtagcttagtatatcatgtcgaattatttgtttttatttcgttttggaccattgagttatatggaatgattgaggcaaacataacttactgagtaatctgataagaaagatgtaagaagacagttattgggtacatgataaattttatctctctcatcaattaatatgcatctgttacaatgcaggtcaagaatctacacatccatcagagtttttcttggggtggttctgaaataaaagtgtggcgtggactagtcgaaggcctttgtgtttacttcctggaacctcaaaatgggtatgcatcagtatattatttacagatataaaagccttagcatcactatttcactaagctcgaagtcctaaaaccttgtactgttttgtaagtggcaatataaaattattaaactgctttgaggaaatatagattttcatgtaattactatcaacatggagaacagaactgaaagatactcctatatagattttgttttgctgcagtaagcaatgattaactacaagatggttaaaattttaaaatgtgtggggttggttgctatgtagtctcttttgggcttgataagtttggtaagtttttgtcaagaggatgaaactttagaccatctctttgttacatgttttttttctcgagggaattatggtatctgctactaaggaaatttggtctgcattctcttgctccacaaccggatgttggctcatatctaggttggtgggaagaggtgggggctgttgttaatggactcacaaaaaaggacttgactcccttatcatcctgggagcctggattatgtggaaccatagaaataaatgcgttttttatggttgcagccccaatattaccatgagtcttagagctgctgatgaggaaagaaaaaaatgggagattgctggtgccaagagcctttcctatttggcagcaccattagctgagaactaaggagggcttttttgtttcctttggtagctgtcctattttgatggatttttttatatatgcttgctatacgtaagtttggtaagttttttttttgaactgtaaatacagcaagggaagccctcactatacgtaagtttgataagttatgattagaaaatccgtttttatattaacttatattataaaaaaatagtatatacactacataattggaatcactggtcaatggtcatcacagggaagtgatggttgggaattagttgctacaatgatatatatgtaaatttgggagtctcatgttctcttttggggtagacaaattactggtaaaacaaggacatggaaaagaataatctgtcactcattcattttgtatactaaaattttaaatgtttgaataatttagataatattaaggtgataatttggtaagcttagaggcgttggatgtctaggaagattgttaagtggttagagtttcagaagtcagtaccattcttctcggttatttggtcgatctgaattaatgtatatggttttgtttaattggagtttcatctctcgtcttcagaagcaagactcagtaatcttctggcctacctttttctaagaagttggaatttatattccaaacctttttttagaatataagtactgtgaattttgtcgtatgtgtatatcagtctaatgatcttttttgcctcatctgactcatgtctgttggggtttttcgtgcagaaggtttcaaaagctaataatttggcacttgccttttttttaggatgtttggagtcggatatgtatatggcagggacgatgaccgccgatttggcttcttctgtcgttctgctctagagtttctcctccaaagtggatcttctcctgtatgtatcattcacaacagtagcggttatattgttttaactgttaccgtctttactatttggctttgctgttggacctttttttactatttgatgcacctatagctaattgttcaaaaactttcttgagcatgcagttagtgctaaacgcaaacaagagaggaattatgacaattgacaagagatataccctctgtactcctgcaggaccttaatttcccaaccatttaacacatgctgtgataaaaaaaataaaattaatcattctattttttatttcactattttagttatatatctttattattagctttacattttaaaaatattttaatgttttctgacttgcagcgaagttgcactgttagcttctcgttaaaactgctgacattttatcctccttattacagaacataatacattgccatgattggtcaagtgctcctgttgcctggctacacaaggaaaactacgcgaagtctagcttggcaaatgcacgggtggtattcaccatccacaatcttgaatttggagcgcatcatattggcaaagcaatgagatattgtgataaagccacaactgtgagtgatacactttgcataattcaatattgtgtttgagaccctgacgtacgtgtcactttaatagataattttacactgtagaattttgtttcttttgacgtttaccttttcacatatatccattctttgcaggtctctaatacatattcaaaggaagtgtcaggtcatggtgccatcgttcctcatcttgggaaattctatggcattctgaatggaattgatccagatatatgggatccgtacaatgacaactttatcccggtacactttattattcgtatgcatttttcttctattggtttacatttattccaaaagcttttccccttccctttctctctctttctctttttggtaacattttattgggttttcaactctagtctaccccaacttgtttgggactaaaagactatgttgatgttgttatacatttcttccacgctacttgaacttagtaaatgaaacaaattaaagagctgcaataataacacacctttttcttcaattgacctagttttgcttagatggacacttaagaccttaagttgaacaaagtcatttcaagtaatgtgcgtggatgtgcgtggttttcttaatccacatctcttgaatttcatgctttggcgctgttaatgttgttcaaaaaatgctgcttatacatggtgggtgtggcaagtagtttcctgcttaaatgtctgttttcaatgagtttcaggtccactacacttgtgagaatgtggttgaaggcaagagggctgctaagagggcactgcagcagaagtttgggttacagcaaatcgatgtccccgtcgtaggaatcgtcactcgcctgacagcccaaaaggggatccacctgatcaagcatgcgattcaccgtacactcgaacggaacggacaggtcattcgatcccttgcattgcatggcacatatatagaacttggaacattctttctttccttaattattcgtgcctttctgtcatcttgaaatgaaactaattaagaatgccatatgtttggtttccaggtggttttgcttggttcagcgccggactctcgaatccaagctgattttgtcaacctggcgaataagctccacggcgtaaaccatgggcaagtgaggctttccttgacctacgacgagcctctctcgcatctggtgggccgacgaagcacctgatcaaaccaactcaacctctcatcaaagtatctctgaaattcccggctaatacagttggttctctcttgatctgctgcagatatacgctggctctgacttcattctggtcccatctatatttgagccttgcggcctaactcagctcgtcgccatgcggtatgggaccatcccgattgtccgcaagactggaggtacgtacgcgtgcagcagctgttgtcgagtgtctgtcaacccggccttcgttctccatttgccattcattcatcagggctgatctctcgtgctgctgctcgtcagggctcttcgacactgtcttcgatgtggacaatgacaaggaacgagcccgagatcgaggccttgagcccaacgggtttagctttgacggagctgatagcaacggtgttgactacgcgctgaacaggcaagcacagtctctcacacagagctagctagactgcccgcttcactactgaacgtaccctagcctgcaactcttactcgtcgtgctgttctttcccgtgttctattttcccttttatttttccagggcgatctcagcttggttcgatgcccggagctggttccactccctttgcaagagagtcatggagcaggactggtcgtggaaccgacctgccctcgactacatcgagctctaccgttcagcgtccaaattgtaataatccaaccaacggccaatgtagtgtgttgtctgcaggtctcagatgcagccattcagcttttgcaggttcctgggcattgctgtacagcctccttgtctttagttagctccattccccgaggagcacagtgcaattttttatcctcagttattatgcatagattgtctcagtagaatgctttcttcgggcatgtatgtttgtttcctctgttgttgaattctggtgttaagtcgtgtataggaatctacaggaaatgaaaaagtccatttcctgcttcaaccttttagggctaccatgcacatgagacctttcaaatgcaaagaatattaggactagactactagtctgtgaactctatttttttccaaggatttctattttttcaaggaaaaataaactaatttttcttcggaaaatggaaatctttttaaaaaatggggttcccaaactagcccgtagagtatagatctagaattggtctagtggtttctcaagaaaaaaaaacatacgccttttcttgtcatatgcttatttaagtttattttgtacaaactttgagatccttcaaaaacaccccaatggctggtgtagtgaccagtgaaataaagaggatcaatggggaggaatcccccacctctctcccgcagatgtcacccagcaccggccaacctcacctgtccaggtacgaccgacgcccccttccatcttcgcccttgagcagcttgctcccttccaactttccccactccacgtgcccccttccatccttgactggatcagtgaaattaaggttggttgcgacgacagcccatcaatggaaaccaacctcgccccgtgtcgggatctaccttcctcaccaccacgccgatctcaccttccataggagctacctaggcactgttacctattataggtacatgacattgtacatctttgtatgaacttacatcaatgccaaaaatccttcaaacatggactatacagtcataggagggtatctttgtcttctcacccacaagacatgttacgcacctctcctgaactccctcatcttttcaacgcttgggttagacaaagctctatctcgtttgccacttcataaagcaggtatcaatgatatgacgaagctttgtttcctccgtaccgacaaagtatcacttcttcctccatctcgacgaagtagacaaccgaaacctatatcacctatctcctgaaacatacttaaaacatagggtttcgttacttgaagacctttagcaaagccttctccccaacagataccttatgcacgatttctacaatagatgcaaaatcataatatataaaggcttcccatgcttcatgcaacaaccctctaaaagctaggctaacatgatcatttttgatagcctcgtagagtagcatttgttctttacttctaggaatcactagatgaaatatgtaacctttttacacttatcaatttgtagattagataggtcaaaaatcttcacctcagtggctatagagaaaaaatgtgcatgtaacttctctagttctatgtagcttctaacggaatttaggctaatgaggcataacatcaaaggctgttcttgatagtgataatgagaatcatgaaattcaaagaacttcagatggagcagcaacaccaagctaggccaagtatcagctaacatgttccatggtactagtgttgttccggccactaaatttggagaacataggaacacaatacttagataaaaatggtacaacatagtatgtttctagagaaggctaagaatagtcgaatgccttcttttttgagttatgccaaaattatatcacaagatttctataagtttgtctataatacatatagtcggcatctcttgaatcttggaattgcggatataactattactccattcagtggcttctagttctatctctactcttttttccctaatgagctactattcttc

SEQ ID NO: 720 - protein, 1674 aa, Zea mays
MEMVLRSQSPLCLRSGPVLIFRPTVAGGGGGTQSLLRTTRFARRRVIRCVVASPGCPNRKSRTASPNVKVAAYSNYAPRLLVESSSKKSEHHDSSRHREETIDTYNGLSGSDAAELTSNRDVEIEVDLQHISEEELPGKVSINASLGEMETVDEAEVEEDKFEVDTSGIVLRNVAVREVDPKDEHNAKDVFVVDSSGTAPDNAAVEEVVDEAEVEEDMVDVDILGLDLNNATIEEIDLMEEALLENFDVDSPGNASSGRTYGGVDELGELPSTSVDCIAINGKRRSLKPKPLPIVRFQEQEQIVLSIVDEEGLIASSCEEGQPVVDYDKQEENSTAFDEQKQLTDDFPEEGISIVHFPEPNNDIVGSSKFLEQKQELDGSYKQDRSTTGLHEQDQSVVSSHGQDKSIVGVPQQIQYNDQSIAGSHRQDQSIAGAPEQIQSVAGYIKPNQSIVGSCKQHELIIPEPKKIESIISYNEIDQSIVGSHKQDKSVVSVPEQIQSIVSHSKPNQSTVDSYRQAESIIGVPEKVQSITSYDKLDQSIVGSLKQDEPIISVPEKIQSIVHYTKPNQSIVGLPKQQQSIVHIVEPKQSIDGFPKQDLSIVGISNEFQTKQLATVGTHDGLLMKGVEAKETSQKTEGDTLQATFNVDNLSQKQEGLTKEADEITIIEKINDEDLVMIEEQKSIAMNEEQTIVTEEDIPMAKVEIGIDKAKFLHLLSEEESSWDENEVGIIEADEQYEVDETSMSTEQDIQESPNDDLDPQALWSMLQELAEKNYSLGNKLFTYPDVLKADSTIDLYFNRDLSAVANEPDVLIKGAFNGWKWRFFTEKLHKSELAGDWWCCKLYIPKQAYRMDFVFFNGHTVYENNNNNDFVIQIESTMDENLFEDFLAEEKQRELENLANEEAERRRQTDEQRRMEEERAADKADRVQAKVEVETKKNKLCNVLGLARAPVDNLWYIEPITTGQEATVRLYYNINSRPLVHSTEIWMHGGYNNWIDGLSFAERLVHHHDKDCDWWFADVVVPERTYVLDWVFADGPPGSARNYDNNGGHDFHATLPNNMTEEEYWMEEEQRIYTRLQQERREREEAIKRKAERNAKMKAEMKEKTMRMFLVSQKHIVYTEPLEIHAGTTIDVLYNPSNTVLTGKPEVWFRCSFNRWMYPGGVLPPQKMVQAENGSHLKATVYVPRDAYMMDFVFSESEEGGIYDNRNGLDYHIPVFGSIAKEPPMHIVHIAVEMAPIAKVGGLGDVVTSLSRAVQDLGHNVEVILPKYGCLNLSNVKNLQIHQSFSWGGSEINVWRGLVEGLCVYFLEPQNGMFGVGYVYGRDDDRRFGFFCRSALEFLLQSGSSPNIIHCHDWSSAPVAWLHKENYAKSSLANARVVFTIHNLEFGAHHIGKAMRYCDKATTVSNTYSKEVSGHGAIVPHLGKFYGILNGIDPDIWDPYNDNFIPVHYTCENVVEGKRAAKRALQQKFGLQQIDVPVVGIVTRLTAQKGIHLIKHAIHRTLERNGQVVLLGSAPDSRIQADFVNLANTLHGVNHGQVRLSLTYDEPLSHLIYAGSDFILVPSIFEPCGLTQLVAMRYGTIPIVRKTGGLFDTVFDVDNDKERARDRGLEPNGFSFDGADSNGVDYALNRAISAWFDARSWFHSLCKRVMEQDWSWNRPALDYIELYRSASKL

SEQ ID NO: 721 - DNA, 8076 bp, Zea mays
gtcaaaaattacagtggccaccgaaaatgatgtacagtgctgttgtaagtgtagcttactagaatttttttagaggcttgtatagagtaaactagtgctaatgcaagtagtctgagtctctacatagtccattcatcattctctagccatctagattcttttttattatatatgttcacatcttggtagcctaatatataaagagactcatgtttaaaccgaggattggattttacgcgcatagagagattactaattgattattctaagagataaagaagtagttagcctgtacaacctctcttgcatgcatcacatgatgaactccatattatatatcatggttttaatacatttttaccatcttacgtaatcttgtgccgcgcaaatggtttgctatggcttcactcttctcttctgcgtgtgaagcgcaaccgcttaaaagcatataaaccatcttctcgggcatatagatttcttaatgacaatctcgcattgtttattgcctcacatggtgacacacagctcttacatttgtccttatactcacggtgcagtgcactactactgtaaccccatggtctggaaaacagcaacgcaacctttctgccttggaacagcaagctatacagcgctatataacaaacttgcacaataatatgctacatttctgaaagcaaactccgcttatcttcgcgttaaggaatggtattacacttaaaatgacaaaatatcacactttagaaccccacgcctttacctaaaaaaaagttgattgatacaagaacaaatgtttacagcttgttacacctcccatcaagcaaagaaatggaatcttttattttatgtacacgtgtacgggtagctattgtttataaattgcagaagacacctcaacatgatggataattgtatacgcaaaactactttcctcgaattccccattctataaattccagttaaacttaattcgtaagatcaatcataattctcgagttgcaaaccatggacatggctttggcgtctaaagcctcccctccgccatggaatgccaccgccgccgagcagccaattccaaagcgtgacaaagccgctgcaaatgattcaacatacctcaatcctcaagctcatgatgtaagttctatttttatttggccttaacagtactgttatagtgttaggaactcatatcctcctaataaccttttctacgtatcagctgtgagtacatgagtgatcttcttcctcttgcacgtgccatcaacatcatgtcaagcgagatcatttgccacgatattactgaaagtagagttaaaatcgcacagccacacgagcagtctgaccaccaccccttcccggccggaccgtgtgtcagtgtggagatggccactcactcaccgatctcgcttccacctccacgccagaggcaacgggctccccgccgtgagctcttcggccacgcgggcgtcttgcctccctcgtccttcctcaccgcaggaggatggccgcgatagcctcagcttcgcccaggaccctgatccctccgcggccgcgccaccacggcgccgcgccctccccatccacctccgacgtctcctcgctccgactcctccgcgcgcacccgcgccacgtccgacgcagccgcggagtgtccatctcgatgcccgtggcgcggagccggtcgttcgtcttctccccgcgcgcggtggctgactccaagagctcccagacctgcctggaccccgacgccagcacggtatgccccgccgcccgccgcctgcacggggaatgcggagggttctcttggagcgcctggccgtctctcgcctggccttgcctctggtccgtcgggtcgcgcctccgaggcgcatttgccgttctccgtgggaaattgggacgcgcgcggaaaagattgtttttttttgtaaaaaaaaactttatatgaataacgcgttgctcatcttgatgcgtaaattggcggctgggtttgtcgcctttccatgcgcacgtttcgtagttgctgcttagacagtattttctttttgtatgtactaggtaccgatgaatgtggcaattttatgatgccacttgttgtgaggctcatgttgttaaatatgattccttgtagtaggctagtagccaataagaatttgatgaagatggtgtcagtgttgtagttgtgggtattggatcattatttatggtttaatcgtctattcttcccatacaaatataatacttattagtttttggatctgatgcagaaactataatggccatttgctattatccttgactcgagtggcctgcgttgtttgaacttgccccgtcttttgaattttgtattttgaatttgtcataatgcagagattatgttattggtttccgtggagctaataatttttcagtttcagagctgtccttgtccttctgtggtgcccattagtttactcactcttggctgtatacaataacacacatttgttgttggttcagagtgttcttggaatcattctgggaggtggtgctgggactagattgtaccccttgacaaagaagcgtgccaagcctgcagtgccattgggtgccaactatagactgattgatattcctgtcagcaattgtctcaacagcaacatatccaagatctatgtgctaacgcaatttaactctgcttccctcaaccgtcacctctcaagagcctacgggagcaacattggagggtacaagaatgaagggtttgttgaagtcttagctgcacagcagagcccagataatccaaactggtttcaggtatccctactactgttgtgtctttctgatttcctcaaatgcaaaatctgccatttctataacatgcacattccacaccatattcacatttttctcattgcatttctcgcttcacacatcatttttttctcgaatacacacatcatttttttctcaaatacacagggggctacttatcattgtattagagagagagagagagagggagggggagagagagagagagagagagagagagagagagggagggagggagggagggagagggagagggagagggaaagagagagcgcgaggggagggagggggagagggggagggggagagagagagggagagagagagggagggagggagggaggggttgttttctttaaatcaatgaacttaaactacagacaactgaaaaatgggtgggacctgaccgttctgctggacctttatccaagcaaccaaacagacaccaccattcacttgctctcttcccttccaaagaaaggctcttatcttatcaatggctggcatctggcaaaaaacatttgggcacattaatcgctatcaagacatgaataggaatagctgataggacaaatctgacccaggtaactctccctgccgtggtcatgagagcagcattccatccagggagtttgtccctaatcttcttgatatatttgagcaattctgcattttctgttggttattgaacatgagtgtcaggacccaaggggacggcagcaaggagcgcaagtcaaaggataaaaagattagttgggattatctagtgaggttatcagttagtagtttgtttagagtttttaggagaattttaaggagataaggatctctagctagatagggatggtcagccgacgtatttatataatcaatagatgagaaataaagtagacaagaattagagggaagaaactctcattttgctcggccgtgggcagaggcccccggccggcgttattgcccatcgatccccctctccaatcccctctacgtgtctactgttcattggtgggtgtgaacagtaccccgccgcctccgccagcagctccaatccctcaccaatcggcaaccataacaatgagtttgaagtgtaccatcatgccataagcaaatgcatgctactctacatgaagttttgctagcccacttcactagtttacgtcatgtattgattttcttttatattttttctcagggtactgcagatgctgtaaggcagtacttgtggttgtttgaggagcataatgtgatggaatttctaattcttgctggcgatcacctgtaccggatggactatgaaaagttcattcaggcacacagagaaacaaatgctgatattaccgttgctgccctaccgatggatgagaaacgtgcaactgcatttggcctcatgaaaattgatgaagaagggaggatcattgagtttgctgagaaaccgaaaggagagcagttgaaagcaatgatggtacacataatatgctttcctttcaagctaacttgatttacatttgtggacaatcattttgtaaacctacaatattccattttactcctttggattgtaggataagtaaaacatagggatagaaaaaatgtaggaatagagttgcatgacacttgcaattccataggaaaatttctaagaggttggacctcattttaaaaatcatccaaaatctcactacaatggtccattctataggaattttataggatttgtaggaagtcatcctttgttccaaagagtcacataggaaaattttctataggattttaatccttcaaagttcctccattttttctttgttccaaaggagcccttaaaatgcattcacatcatattgttgtttgattgatgtaggttgacaccaccatacttggccttgatgacgtgagggcaaaggaaatgccttatattgctagcatgggtatctatgttttcagcaaagatgtaatgcttcagctcctccgtgaacaatttcctgaagccaatgactttggaagtgaggttattccaggtgcaaccagcattggaaagagggtatgcaaagttgttttaaccttttagctgtttgttttcttctgtttactgatgcttctttttttaatagaaaaggtactatataaccttttaacacagatgtcattatgccataagttggtaccctgacatttcatttctgaaaaagtgcatatctgaagttttatgtgcatcaaatgctgcctaggagcagcttactagaaagcctaggcaggttgggttgtctcaaggcaggatggaaggaagggttgcctttcagaatggaatttaagaccttatttttgtttgcaggttcaggcttatctgtatgatggttactgggaagatatcggtaccattgcggcattttataatgcaaacttgggaataaccaagaagccaataccagatttcaggtatgctttcacttctcactgtgctgcagttggaagttgcaacgctgcatgcatatcaagtcttacaatttcaattagttcctactgatttagtgttccccttaaatctgaatacagcttctatgaccgttttgctccaatttatacacaacctcgacacctgccaccttcaaaggttcttgatgctgatgtgacagacagtgttattggtgaaggatgtgttattaaagtaagcagtgcttttactgtagcatatttgaaaacctttctatacttcttttattttctccaaagtaatttctcataattcatttactaaaacgtttatgccttgatcttgtgcacacagaactgcaagataaaccattctgtagttggactccgatcttgcatatctgaaggtgctatcatagaggacagtttactaatgggtgcggactactatgaggtaaatatatacgtacaagtatatactgctgtcaatgcaacaatagagctcacacagctgtgttctttttttccagacagaagctgataaaaaactccttgccgaaaaaggtggcattcctattggtattgggaaaaattcatgcatcaggagagcaatcattgacaagaatgctcgaattggagacaatgttaaggtattccaaactgatgttccaacggtcaagaatattaatttagatttttccttaggatattacataatacttgatatgccattttgtcctcttatttttaacatttatttttgaaaatattaacttgaaaatatgaataggcttgcatgctcttttttaaatatgactgtctatacttatctttccctaattgcctgcataaattttcattcttcagttttgtctgtatttaactgaggtaatcaagatgaggttctgtttaccacaagataaaaaactgtcaacaagtcatatatcactttttattataaaaatacaaaataaaacctgaaatgcagagcttcatatcagttctttatttggctttccaatactgctcatgcggatgacattcaagttcaacccagaaagggctgccactatccagcaaaccttgctctgttatcggcattgtttgatagacctgttgcacttgactattcataaatcttcgcttgtcataggattaaacaggaaactttcattattagactttcctgccacaaattttctatggcagcggcatttctcatgagactcgatcttgtagatactcaatgctgacaatgttcaagaagctgcaatggagacagacgggtacttcatcaaaggtggaattgtcacagtgatcaaggatgctttactccctagtggaacagttatatgaagtaagctttccccctattcctacacaaactgctgtcagtaaagtttcacttgcgaagcctttgaaacatttgtcaactaggttgcaaatgctacatctttgctcgaacttgcaagcttgcctgttgaaaacatccttgttttgtgctgcgctgcaggtgaacgtgcgacatgcagctgtgtgtctcgacattcgacaatgatcagcacctggttacatgcgtgatctgcagatcagtctgttggagatcatcggagcaataaaagtgtcatccaaggcattttttctttctttttgctcttttgtgtccttcaatgttgtagggtagaatgttgtagcagcaaatgttagttacatgttgaatcgacattgggggcctggatttggggatacatcatgctgtaaattgatcagtttaattaccatactgtgctgctttgagcgaagccatggagaccatgctccacttttgtgcctgacgaatataagcgttgctggtttggagtgcggattttaaagatatataccatctgatatgttccaacatccaacgacagccatttccaccgtcacattatcaattctgcagaaagcattctaactcactactcaacacattatcaattctgcagaaagcattcttactattcaaccaggattcaaaaggtctcacagacaagattgatacgtgcctcttattaactagggtgtgaggttatttatgcaacatgtctcttggcgtgtggtgcgtaggcgtggagttcgaagacaatggtcgacgataaaggtgaaggtaatgcggattcgtaccgatggaccggcaaaagacgaacgctaagtcttttttttttgaagaaacaggagtggaacgagtcacaactgaaatatattaaaaccaataaatgttgaactattacaaaatcctattacaaaaaattatgataagagatttcttcattgttcagcagttgggaaacatttcttccgccgcatcctatgtgttagactgtgtgtgtgagtgggccggcaccactgttgggctgccggcccattagggttagggttgagtctctatatatattgtattccatctattatcaatacaacaatccactccattctacatggtatcagaggattagggttagggtttcacctcccacagcagccgccggctgcttcaaccacacagccgctgcctaccatcgctgccctcgggaggctccaccttcgctcccgggggcagcctctctcctcccagccgccgctgctgcctccctgggcaggcagccgcaccccccaccccttccccagccggctgccagcctctggccgctgccaccctccagccggcgagctcgtgctccctccagccggcgagctcggctcccttctctgccgctggccctggccgcaccggccgcgacagcccctccccgctcgggctcacctgcgcgcccacccctcccgccggcggct

SEQ ID NO: 722 - protein, 475 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAAMETDGYFIKGGIVTVIKDALLPSGTVI

SEQ ID NO: 723 - DNA, 2675 bp, Zea mays
aaatctcttcattccatgaagtggtgacaccttgaggtacacatgatcaccttcctcaaactccggtggtcttcttctattatcagcgtagctcttttgcctggtctgagctaccctcaagttttccctgattatacagacttgttcttctgcctcttgaataagttcaggtccaaagaactggcttcctccggtctggtcctaatatagaggagtcctgcatttcctgccatgtagagcctcgaacggtgacattttcagactggactggtaactattattatatgagaattcagcataaggtagactcttgtcccaactactaccatgttgaagggcacaagctctcaacacgtcctccaatacttgattagtcctttcagtttgtccatcagtctgaggatggtggaccgaaataaaattcaactttgtatccatattctcatgaaaacttttccaaaatctagaggtaaactatgatcctctatccaaaacgttaaatcatgtttgtttaagtccaatcgtaatcgataccacactacaaatggatatcgctttattcaaatttgttaccgccggtatttgagtgtgaatcgttaccattaccatttactttggggtgtataaaatgatataatagccgataccatataaattttttaatttggtgcctatctatcatatgtactacctgtgtatcctttggacatgatatataaaatgatttaatgctttacatatatattccttattaatttggtgcacatctatcatcagtaatttaatgatttaatgctttacatatatattccttattaatgctttacatatatattccttattaatttggtgcacatctatcatcagtaatttaatgatttaatgctttacatatatattccttattaatgctttatataacatgatgtaagcctttagcatatattatatatattactggtggtgtgctcgattattcatcgacaagtcgcttcgcatacactggtgtatcgacccaaggagagatgaatgcgatgaggctgacgccggttctcctcgctgttctgatgatgacatgtctcgtgtttgctgcaaattgtggtacgtgaaccccatcacacgatttgttatgcttattcaatttagaagaaaaaaattgatgcagtgaagtgcagcgattgccggcagccatgacgtggagacgacaccggctagcggtctccggcggccgccgccggacgaagagaagacgatgttgggaagcagcgacataaacatcaagttgtgtttgaaagctcagtgcgccggttacaagagctgttactgctgcttcactttacctggtttgccatgctggcctgatcagaacacgtgctggcaagagtgtcccaatcgccagcgactccgatccacccgatccatgaagcactccgacgcgatgccctccataggtcccagcaggttctcatgagaaaggatctggcctcgaattctcctgctttgagtgacaatatgtgataccgtgtcatgcatagcagcgtgagtgtaggatgataataaataagcaacattccatgcaacagtatgcattgcagcgtgttatatcttaggcttgtatggcaggatgtaacatacttactttgttctaaaacaaatatacttactcagttttcttgctttatggcttgtttgagggttggagaggatcgaaggtagcaagagattttagccccttcgatccactttaatttccttctcttaaacaagatcttgtgaaccttttttaggatttttatagtttacccactagttttggcactctaatcagttttactcctgctcgactcagttttcccgttccaccgttaacctgtgctcagaaatcacctcatcttacatgtagacccgtaacagggtaaaaaatggtttgttgatgcaaaaaaagatcgaaacagagattcaaactcaacacttcaactattttaacgatgccaatgaccactaaaacagatacgatgcttgtacatttaatgcataacagtttttataacgtatctctgtaacacctacgcggtcaattttttcaaaaaaaatttcccgctgctcctcctcatgtccgtcacgcgccgataatggaggctggtgcagggtgaccgcgcgcgggccagggcgctcaaggtcgcggccttcttctccatcctcgtgtgcgggacaatgggctgctgcttacctgtgttgtgttgtgctgctgctgtgcgcctgtgcctcactcgttgcaagcggtgtcgccgtcggtgacaagagaagcatcagacgtccatggtcgtggcgtcagaggcgccgccattgacggggcagctgcagcggcgacaaccacgcgcacggtcccacctgtaagtcaccgggtccatctgtaaggcatctaatggatggacggaatgtattccgtattgtgatttctaagaataagttgaaggtaagggataactgagtagaacactgagtacagtgccaaaactagtgggtggaatgtaaaatcctttttcatgtactataaagtatgagtctatacttaattccttgctaagatgttcggcttccacttaaattttgggctggctccgcacctccgcatctaatgtctttagtggatcgtgtcaaataggggatacaac

SEQ ID NO: 724 - protein, 123 aa, Zea mays
MNAMRLTPVLLAVLMMTCLVFAANCAIAGSHDVETTPASGLRRPPPDEEKTMLGSSDINIKLCLKAQCAGYKSCYCCFTLPGLPCWPDQNTCWQECPNRQRLRSTRSMKHSDAMPSIGPSRFS

SEQ ID NO: 725 - DNA, 2515 bp, Zea mays
cattcttttacataagtaattatatgttgcctaattttattccaaattacccgcaggggtatgcttctagttaacaatatatatttatcacggaagcatattgtttgctttcatgacaattccaagcaataccttgtgttactcaggtgtctttgagacactgcaaagaatttgagtccggtagtgctagcaccattgtgactctttgaaaaagccatggaaagtatttgacaagatttatggttagagatatttgctcgttaataattacgtgggaatcgacatatggccatgaactcaaggtatgtacaatcctgagactccgatttagttttcaaaaaatacaataaacagttaagagactgcatatacaacactgagattctggatcataaatataactaagagacaacatgtatggagagtcgtgaagaaacgtactattcgcgaagagcctgtcgcttgtatttttttcacttagcctcttagaaactcctagagaaaccctatattacatagggttgtatatgtcggaatacattccaatgttacaattaatgttcgtatttaccattaagcaagtagatacttaagcattaaatcattgtgcaattactttgaatactaatgtctatgatatctgtatctggatttagttgtttagataccatcgaaattaatagggttgttcataatgtgtttgaattaaaaaaacaatagctatttcgtgccataattaaattgtttgatacggatgatatcaacaaagatctagatagaaggttgggatatttttcacaactgcaaaatcattcacagcagaatatcttcgcattattataagacgaaaacatattttagtagaagattggacgatatcgaagtttcatctcgagatatcaagcaattaatgtaggacacatacaatagatttgcctaaccatcaccttctatcagtccatccatctatatatatctgcacacaccaccacagcaggttggtaaaagcacctcatccccctgcatatactaacactgcaaaactgaaaagggtgatagcaaactacaatgaggattgtgtacatggcagctgttatgtttttggttcttgcaaccatgtcttctacctccccatcattctgccaagctgggggctgtaatttttttaacttttacttatcttgcattggcttttgtgatgttcactggcaaagaaccttgcttgatctgtatggtgtttcatacgtgtaggcatcggctgcccacgggctccaccaccgccgtccgatgagacatgctacgaggacctcaagtgttcggcttcgaggtgccacctgggttgcatacacaggggctacaagggtacgggttcgtactgccgtgggagggactgctgctgcaaacattgatgcaccgtagtgcatctatgcatttcatgaccatacaataaacctagatgtgtatcctttgcctccgacgactataaatgaaatgaaatactactaaggttcagcatccggctcacactcgcccttccttgcttcacggacgcgttgaactcacctcactgctccttcctcaacgcagctttgcgccgacggccatggacccccgcgctcgctccgacgcgaatcctcgcggtcacagtcatggatcttcgttactttatgtcttcagttcagtttggtagctggtttcagttagcacaaagtagcagttcagttcagtttgataaggaagcaggtttcagcttgagaacaaactagctacctctcagtcagcttgagatcaaagtagcagttcggatgtcacattaatcacaatagtaaaaacgatacaattccgaaggctatattctgtctgatggccttctagccaaccatcggatctaatgttatatccgatggcccatgacagccatcgaatataagagcctacgtccgacggctgtcagacagaccgtcggacataaggttatgtccgaacggctatatagaatatgttctcttgaaggttacacaaacctagcctcatgggttgcataaaaaagttgtagaaaattgtataagattttcataatagtaaatatcagcagcctgactggagaagatggagcacgggaggatgatgtccgatctagcgtcacggcagaaaggcggcccaggcgcagcaagcgttcttcaaagcccaacaccaaatactacggcccacgatgggataattaaacccatttgtaatagatatatatatatataaacccttgtccggttcggtgaacagtaggctgtaagaacacagcgaactggcggcggccacggatctctgatcatcggtccgagataacgagcgagttgctctgttgtgagagaaactacccacagtgatcgcgtgtgtttacatttggtactcagagccaagtctggatccaccacacgagtactggacgcggctctaggcgaagacgacggaaatggctccaccgcgtcccgacgacctcgtgatgcagattctggcg

SEQ ID NO: 726 - protein, 81 aa, Zea mays
MRIVYMAAVMFLVLATMSSTSPSFCQAGGCIGCPRAPPPPSDETCYEDLKCSASRCHLGCIHRGYKGTGSYCRGRDCCCKH

SEQ ID NO: 727 - DNA, 2563 bp, Zea mays
ccaattaaatagttaaaacatataagtatgatactataacggtgtatcttgtagcctaagtgatatggtattggtttgtcgccagcagcacactgtattaataaacttgttctaagcggtggcgactgaaggtcgcctctccttaggggtgggctggtgctaggccagcggttgatgggatttcgagtggacgagattggttgctttgtttcctttttcgtgtgcgaagctagcgggtgggaccggtatgtagagagcgaggggaatcaagtggtgggctgtgggcaccgatgctggggggctcgagcgaaatcgtgcggaggacgattcctcatttgctatgggtgccttttagttatagatagaaagatagagatagctatatcaaattttattttttaaaaaattatataaaataagtattttcaattggttcctgtggtttctctttatagatggcttttactatatattttatcaattatgtaagctttgttaaaacagacatcaagacctaataataaacgcaagaagttacatgcatacaagagaagggcataggcacaagaaaaaactacctacaaaggtataggctgatcacacatgttcatttgaggcttggcctctggtttcgtagctatgcctttgtatggattagtgatctacttgtcatttgtgtgatgtctataatgactttgtagatgttaagatgcgtatggtgcacacgcatgctttaatggaggtgattttatagatacctgcacctaatgagcatatctgagaaagatgttcatcataaatgttagcatatcttcaaccccccccccccacccccacccccacccccacccacacacacacacatgcatatcgcttgtattgtgcatggaggatcgcaggcattaactaaactctggagtccttgtgacttccccttccctataaattccactaacgtatgcttgaactgccaatagaacatcaagtttagattcttgttcacgcgttcaaagatgcgtggggaaaacaacatagtcctccttctcctcctcctgtttgctgtaatttctccgaaccaagtaattggtagtgcttgtactccggaacagaaggctgccatcctaaatcaatgcgaagagtacatcaagcctggatacccccttatactgccatcgtacgccagtgtgtgttgcgacaaggtgagagatgtgccaaatagggacatgaactgcatcgtcgatctgctcacgcctccagagaaggcgaaacacggtgtcgacaagataaaacgtctgaaagatctctgcgacaactcgcctcatcatcaggtaaagtttcagatccattcattctgccaaataatctgcaggtgctgaaagcctcacaaatcccgttttgcgtacaacaaggtggtggtgtagacagacagcagctgtcattgctaatggagttcggaggcaagatatatggtctagtaaataaagtcgtcgatcaaagcatgacaactgtcaaatgtatctttgattaagtaaagtatcactcaagatttccagtttcttttttttttaaaaaaacgaatctggttgaagagctctatttaaattaaaaagaagaataagcttagactgagcagtacaacaaaataacagcgaaaactaagaaactgccccaacaattatgaacgagcgagaaatgatatgtaatctaaactcagccccattccacgcaagaccgtatcagtttgatgctttgatgtagttgaacaccaccactccgacgctccactgcacatctccgaatagcgggttgccacagtgcaccacatctttggaagacaaagctatatataaaacgatgagccatcgtcactgcttccattgtcgttgtcaacgatgccccatacccatctagttacagcagttatgcaggttggctatcatagtctactacaagccatgtagccgcacaataccggatccccttgcgctatcgaaggacgttgtccctagctagatatacataggctgtctgacccgactcaatctgatcgaaatttacccaaaccagttggatcgggccatgttaaagagggcgagctcggtccatgctttctaactctgcagaaaaattgggtcgagcgtgagccaccatttagaccacgggccggcacgttgacccgacataaacgaagaatccaacacatcaaccatgatgaagcacccaatcaaacatgcgacatcagcccatcataactcaacagcccatcatattctctcaatcctgatctataactctacacaaccggcaaacgggaaacctcccacggcttcgttcggagctgtcgaatataaggttttgtccgacgacttcctacagccgtcagatataagggaatacgtccgacggctatcagttaaaccatcagacataatcttatatatcttcgacggctccaactaagctatcggatataagggaatttaagcatacggcgccctagctcgccgtttcatttcgcccgaacgcaccgtcatgaaacaaagagcaagcccacgccgccggt

SEQ ID NO: 728 - protein, 108 aa, Zea mays
MRGEDNIVLLLLLLFAVISPNQVIGSACTPEQKAAILNQCEEYIKPGYPLILPSYASVCCEKVRDVPNRDMNCIVDLLTPPEKAKHGVDKIKRLKDLCDNSPHHQVVV

SEQ ID NO: 729 - DNA, 8604 bp, Zea mays
gttggatcccgagtagatccaccagcaaaagtgggggcgcccgcccctttgcttccaacccacgcaaaaacccggatccgatgaatgaccctccacctccacttcctcctcacgggcggtcgcctcgtcgtacagacgaacagaaacaaatggcaagcaaaaaaatatacaataccaacaaaataccgcgaaagaatgctacggtcaccggggtgcatctgccgccaattcgacagccgtgtgtctctgtctcttcaaagcacggaaaggcaggccgccggggcgagtgtggtttttttccttgtgtgcaagcattagggtgcaggtaccaaaactgctgcgcgtcagaaaccatggggtcatcagctttggcggattttggaggcggtgatgtgcgctccctctgttttctcatgtaccaaggtcagaaggtgacgcggcgtcggaccgtgtgcatttatttatttattattacaacagcgagattaccgtccgaatgccaaatttattactaccgaaacaaaaaaaaataccagcctcgtctgttctacttctagtacgtacgtacgtacgtacagggcgcgtcagcactgcttgtgcttgaggacaaaaaaggagtggtttttagtggcagaaagttcccgctacttgtcacgcattaaacctccgctgatttaggagtagaaaccttctttcaaaaaaaaatctttgaagataaataaaaagagagacccaaaatactccatcccaagctgatcatatccgatcatacctggacatgtaaacaaaaaatccatccgtaaaccagcatcagatgaagaaagcaaacccaatgcactaccaaaaggaaagaaagaaaaaattcctaatctttcttatccctcacctaccatttttttaaaaaaatctaatactacatgggcaagggacgaaggtggtgggagcaaagaggcccccacccctgcccccgcaatgcgtgtataaaacggggcccggggctgccgctcaactcacccatccattccacctccgttcaccccgtccatttgatttgcgttcactgcgttgcgtttccttggaggggattgttctctcctctcctttggattggaggtccctccttcttctcctctctctctcagaggaaggtaatgcaatgggggtgctctagccctctcctcctctgctcctgccgtcctgcgtgggtgcgtgcgtggacgctggtctgctgtcctgctccgggcgaaatgccgccgccgctcgccgtgactgatgctcctcctcctggtcgtgtccgaacgcgccggacggtgccgccggtagcatgtaggaactatacgctccgctcggacctggtcatgatcgatcgatggtgtaggggaggtcatgccgaattttttcgcccggttctctgaacctgccgccactctgcaggcgggggaggtgctgcctctgcatgcagttgctttccttgcagctatagccaaaacaaacaaaacaaaagacgggtttttttacggctgttgtaccagcctaccaggggatagctagcgactagcgtccgtgagatccagagaactattgtctgccacttgacgagatcctaggggagcggagggagcctgcttatccgcgcaggaacgacggtgttagcttctggatctggggtttactgagcaccaaggctcttgcaaactccgggtttaaggtttcatatatatatattttttgcatactcccgagttggtaccagaacgctagtagatccggcgcttctttgtttcctctttaattaaccaatatttttgcaagaaatatttctgtgacgattttcctcggataagttgttgccttgttggctttatccgtccggatgccccgccatgtgctccttgtctcgggactcggagacaggctgacagtcctgggttcttgtgctaatggccatggttaacttacgttaatcctgcgccttattatcatcatctaggtgtaattacttccgtttgtgctaatcacctcgtgattgcctgcaataaggaaccccagcccccccaccttgctgatgccgtgcttttctagagaagtaccctgccgcgtcacgcttcgtcctcgcctgctttggattcaacggctttttggaggccgaggccattggtgccatgcggccagcccttttcttctccatggttcccatcgatgtgtttttgttcggttctctcgtcagatctgtataaataggcgcctcccttctccgccattcctcggtcctctgaagcgtttcagttcatcgattcagttcttgtatgcctcttgttgtattggttgtttcttctttctggtctaggtactaggactatagtaccaggatctgagtcgtttttttttgggtcttgctcctgtctgccgtttctttccccccttccagagttaggttctgttggtttcttgcctgcaatatagtttcgtggcgcagcgtcaagggtgtgtcgagacttaaaagactggttgttggcagttgggtttatgtcttgctggaggggttttagttttaggatgtcatcgcagcttttatgtcaacggatctgaaccgtttttcggtttcagttttctctgctgactgaagcttccgcttccgtttcggtttcgctgtgcaggcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggtctgccctcatttcccccgcttcgtctgcaagtttacatttattttgctacgggtattatttgagcgaatgcgactttttaagaccagttccatcatattatgtattgttagatctagcatgatgtggccatcattcaatgctgtagacataatgttcctgtgttccctaataagatgagtatttaattagcatccaggattttgtcgaaacctagtactggatactgatgatacatacatacaccatgctttttttagtaccgactgtaaactgctgttagatctggctgcacctgcatgtgtgttctttagttttatattcaatacgatgtttctgaacagaatgattggagtctgaacttacccaatgtatagcttgttactaaagggtctatcgaatacgataatgcttgctaaccagtttatgcttagttctgacacgttctgttcagcatgaacgcataggcatctgactagatcggatgtgtaggcatgaaaggggtttcgagaagttcagttaaaagagaggaatctttgttttcattttttcgaatgaatttgctgttgtgcctcttcgctatgttgcatatgttcccacgctactgactgctgatcatacgtctaaactatttcttgaaattgtatatgtttgatgagtttatagatctggcatagtctgatgttatttggcacatcgttttgcgcaggctgaaaaaccttggaaagggtatgctgcagccccaccagatcattgccgagtacaacaatgcgatccctgaggctgagcgcgagaagctcaaggatggtgcttttgaggatgtcctgagggcagctcaggtttgcatcagattcagatctcgctggacagcactgttccttttgtagtgtgcaccttctttaatcattctagctctattatcttacaggaggcgattgtcatccccccatgggttgcacttgccatccgccctaggcctggtgtctgggagtatgtgagggtcaacgtcagtgagctcgctgttgaggagctgagagttcctgagtacctgcagttcaaggaacagcttgtggaagaagggtatgatttttgcagccccaacaacaactttgattaatataccatgattaatatacttttctaaaataaaaaggttttggtcatatatatgacagtttataatacttttggtgtatatattgcagccccaacaacaactttgttcttgagctggactttgagccattcaatgcctccttcccccgtccttctctgtcaaagtccattggcaatggcgtgcagttcctcaacaggcacctgtcatcaaagctcttccatgacaaggagagcatgtaccccttgctcaacttccttcgcgcccacaactacaaggggatggtgagccattgttttatctgtttctttacttaaatgtcatcgatattgtctagaagttgtcaaaagggtgttagcaaagtggaaattttgtatcattaaggctgacctgtgatgcatacccgataaataatgagttgctgagctgtctaaaatttttaaccacaaggacaccttaaactatttatccatatattcctgctgtggtagttgtaaattggctttgaactagctggaaaaatctgaaattctatggttccctacagaccatgatgttgaacgacagaatccgcagtctcagtgctctgcaaggtgcgctgaggaaggctgaggagcacctgtccaccctacaagctgataccccatactctgaatttcaccacaggtactgaatactttttgttgactcgtttacatatactaaagcaactgaagcatgtactagtactcttgcgatttaacacataatcctgactggacaaaaacaggttccaggaacttggtctggagaagggttggggtgattgcgctaagcgtgcacaggagactatccacctcctcttggacctcctggaggccccagatccgtccaccctggagaagttccttggaacgatccccatggtgttcaatgtcgttatcctctcccctcatggttacttcgctcaagctaatgtcttgggttaccctgacaccggaggccaggtactctccttagccactcaggcacggatacacagttaaaagaaacactgaagtcgctctgatcaatctgtattccacctgcaggttgtctacatcttggatcaagtgcgcgctatggagaacgaaatgctgctgaggatcaagcagtgtggtcttgacatcacgccgaagatccttattgtaagtgtgatgcctaatgtgataaaaaaggaaaatatagcggctaaattggtgacattaagaaccttatttgaattttttttttgcgcaggtcaccaggttgctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgtaagtaccaaaagatactaggagttgctactaatctgttggtgaaagacatagttcttgctgactcttttttgtttgtttgaattgttggtaggacgtggcgcatgagattgctggagagcttcaggccaatcctgacctgatcatcggaaactacagtgacggaaaccttgttgcgtgtttgctcgcccacaagatgggtgttactcacgtatggactcttttcgattcaactggaagtaatttttttttaattaccacctcctgctcattcctcatgttggccttctttttccttgatacatattgcagtgtaccattgcccatgcgcttgagaaaactaagtaccctaactccgacctctactggaagaagtttgaggatcactaccacttctcgtgccagttcaccactgacttgattgcaatgaaccatgccgacttcatcatcaccagtaccttccaagagatcgccggaaagtaagtgatctatatatatacaagcaagattaatgttcaaggttgttaaattcccatgatctaatgcatgccatcttctgttctgggtcttcagcaaggacaccgtcggccagtacgagtcacacatggcgttcacaatgcctggcctgtaccgcgttgtccacggcattgatgtgttcgaccccaagttcaacatcgtgtctcctggcgcggacctgtccatctacttcccgtacaccgagtcgcacaagaggctgacctcccttcacccggagattgaggagctcctgtacagccaaaccgagaacacggagcacaagtgagaaaccgcctgtgccttgctcaagctaagcggtattggttgttgttatctgactgtatttgtatctgtatctgcaaacgcccgtgcaggttcgttctgaacgacaggaacaagccaatcatcttctccatggctcgtctcgaccgtgtgaagaacttgactgggctggtggagctgtacggccggaacaagcggctgcaggagctggtgaacctcgtggtcgtctgcggcgaccatggcaacccttccaaggacaaggaggagcaggccgagttcaagaagatgtttgacctcatcgagcagtacaacctgaacgggcacatccgctggatctccgcccagatgaaccgcgtccgcaacggcgagctgtaccgctacatctgcgacaccaagggcgccttcgtgcaggtagagccgtaacgtaaccaccagctgctgcgctgttattcagaggtcttggttgcaactgacccctggtgcctgttctatctgtgcacagcctgctttctacgaggctttcgggctgacggtggttgaggccatgacctgcggcctgcccacgtttgccacagcctacggcggtccggccgagatcatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtatgcactgacgtgaagatggtttccccagccgttttttttgatgtgcttcttaccggtcgtcgcgttcggtactgcaggtacacctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctgcttttgctaggcggcgggcgttcgttgctgctctttgcttcaagagttaaatttacctaccttgtcaaggtcttgttccatcattgatccgggtgtcgcttttttagtagtctgatggactgttagtagtttgcgttgcgtcggttgagagggaacgttggtggtggtggtgtgtgtgcagtcaggcgtggtgctccctttgtttcctggatgggatgttgctccttgaataataatcgtagtggccttggagcccttttcctgaaataagagcagcatcctagtgcttacctttgcagctgtaactggtgtttgcctcaggatttttgctcctcccttctatggattgtgcttaaaattctctataataaccttacagataaagctttatcacctgatcctttgaagaaataaaaacaatcttgaacagtttttgtaggaactttatctcgaataaaatggtacccaacttctatgtgctttgttctatgctacaaatattttgctccaatattatcacaccatagtcttgatgtcttaagactaggagtattaagttttttaagaagaatttgcacccacataatttctactacacatttgctatgactttataatccatttcagtactagaccttgatacggtgtcttactaaagtacacaccatgagataagatgtctaaataaactacaaaaccacttgtagatcttttatcattttatatctcgtatccagtcgacataagagaaagcactgataaaagtagaatttaactttataattttcagtcctaaactagtggtgtgtttgatatatcttaatattcacttgactgatgtccaacaaatagtagtagaagcatatagaaactgatataccttatttactaaaaacttaatattagatctagtcgatgttaggtcatcatttgacgcaagttctactgcacttctatagcttgcgtcatcatttggccctagaggaggtccttcatgaagtgatagcttctcacttagtgaaagtggtgtgcaaacaagtttgcaatctatcaaacttatttaaaaagatgagatacatactttttctgagtaagtacaatcttatttgaagttctctttacttctatatcaaaagatagtgaagatctactaggggtctatttggttgagttgtggatgtgaaaagtaattgttgtaggctgcgagttgagaaaaaagctattgtgtgatgtgaactgctaaaaagataaaaatcgttttgacacatcttcatagcgagaaggttgttctatgtagatctcttcttctagatgcccatgcaagaatgcat

SEQ ID NO: 730 - protein, 816 aa, Zea mays
MGEGAGDRVLSRLHSVRERIGDSLSAHPNELVAVFTRLKNLGKGMLQPHQIIAEYNNAIPEAEREKLKDGAFEDVLRAAQEAIVIPPWVALAIRPRPGVWEYVRVNVSELAVEELRVPEYLQFKEQLVEEGPNNNFVLELDFEPFNASFPRPSLSKSIGNGVQFLNRHLSSKLFHDKESMYPLLNFLRAHNYKGMTMMLNDRIRSLSALQGALRKAEEHLSTLQADTPYSEFHHRFQELGLEKGWGDCAKRAQETIHLLLDLLEAPDPSTLEKFLGTIPMVFNVVILSPHGYFAQANVLGYPDTGGQVVYILDQVRAMENEMLLRIKQCGLDITPKILIVTRLLPDATGTTCGQRLEKVLGTEHCHILRVPFRTENGIVRKWISRFEVWPYLETYTDDVAHEIAGELQANPDLIIGNYSDGNLVACLLAHKMGVTHCTIAHALEKTKYPNSDLYWKKFEDHYHFSCQFTTDLIAMNHADFIITSTFQEIAGNKDTVGQYESHMAFTMPGLYRVVHGIDVFDPKFNIVSPGADLSIYFPYTESHKRLTSLHPEIEELLYSQTENTEHKFVLNDRNKPIIFSMARLDRVKNLTGLVELYGRNKRLQELVNLVVVCGDHGNPSKDKEEQAEFKKMFDLIEQYNLNGHIRWISAQMNRVRNGELYRYICDTKGAFVQPAFYEAFGLTVVEAMTCGLPTFATAYGGPAEIIVHGVSGYHIDPYQGDKASALLVDFFDKCQAEPSHWSKISQGGLQRIEEKYTWKLYSERLMTLTGVYGFWKYVSNLERRETRRYLEMLYALKYRTMASTVPLAVEGEPSSK

SEQ ID NO: 731 - DNA, 7694 bp, Zea mays
agtgaagacggttgtctcacgcaatatgtgaagtgcaagatgagctctacactgcaaggaaccccaagaaaaaaccacaggtaagtttgtctgattgacaacggctagagctgtctgacgatgcagatgactccgcatgttcattcatcactttaatttgttagaaaagctacacaaaaagcacatcagaaaaaaagaagaaaaagctatttagtggtactactagttgcaacttgcaataatgatgatgataaatctgcacaagccatagctatgctatatgctatagctatgtatatgtacacaaaaaatacattttttgtgctattttttttaccgctagtataatatccatgtcttgctacaacacacaatcatatttaatacctataaaaaataaatttaatattaaaataaacatatggtccacaccatatattaaactgctaaaaacaaatattataactcatttgatcgttcatcctctttcggttagtgaggtggacagtgagagcgctgcatcgtgttattgggtttgactggtttctcacggctcatctgtgttgtaacgacctatctatggtcaaacaaactattaggattattgttaggcgaaaaatgagggagataaataaacctataagcaggacacatgaaacatatgctttaaacagtagagattaacaacataaaataaaaaaaggcaaaccgggaagcgtgcaagcccaaaggccaatcggcccagaaccagctccacggttgttcgtgtccgcccacgtggcacgcccggccattccgggcccacagatccggctcagggtcatgtgccactgccatggccccctccttgtcgcagcggcagattgcgacggggaagaaaggtgaggagaccaagcgaaaaaaatcacgctttcattgcgaggggggaggatagggaggaagacgccaagccagctccagtccggcacccgatataaagcggcaggcacttggattgctgacgagatgggactcacacgccgtcacaatgctgtgcctcgtgtcgccctcttcctcgccgactccgcttccgccgccgcggcgctctcgctcgcatgctgatcgggcggcaccgccggggatcgcggtaagctgcggcgatccgggggctggtggatttactacttttgcttttttttcttctgtactgatggttcatagtttcgcagggtggcggcaatgtgcgcctgagtgtgttgtctgtccagtgcaaggctcgccggtcaggggtgcggaaggtagatctttccccagattagaacacgttgttacggacaaaatggaatttggtagtagttttggagagagaaaaaaaactctggaatttgtggattgggtctcgctctcgctttggatttggctctagtgctttgttatcagtagtaatcattttaccaagtctagcggatctcagatttcaactgaagttgtttaaattttggtggttggttttcttcagccatcctaatcatttattacataataattagttgaaataaagtgctatatttgatatttctgtggttgctgcagcagctaattagcttcactacattttcacgtgttagcttctattgctcgtgtaattctgaatctggctttaacgcactgtgcaaggtcaagagcaaattcgccactgcagctactgtgcaagaagataaaactatggcaactgccaaaggcgatgtcgaccatctccccatatacgacctggaccccaagctggagatattcaaggaccatttcaggtaccggatgaaaagattcctagagcagaaaggatcaattgaagaaaatgagggaagtcttgaatctttttctaaaggttaggcttaatacattcaaatgctaatacaaggaccatttcacaatatttatagcacctgcccatgccgcaaaatattatctgcatcatcaacatttccggattttgtatttttttcaggctatttgaaatttgggattaatacaaatgaggatggaactgtatatcgtgaatgggcacctgctgcgcagtaagttctaatgttgtcatgcaaacatgatgtactggcggggtatcgttttttcccattttgcttgtgaagagatatcgtctgatagtaactatattaaaaaaaaagaacagctaaaacacaggagagtaatcaatgtttgggagtagaaaactgttcggatatttcattcttgtgcaagactgtcatgtcttagctgaggaggctattttttttcttgctgtgattacataatgctgttttcttcttatgacaatatactttccactattttaatagattgatgcatttgacttgagttttttactcatgggtgtagggaggcagagcttattggtgacttcaatgactggaatggtgcaaaccataagatggagaaggataaatttggtgtttggtcgatcaaaattgaccatgtcaaagggaaacctgccatccctcacaattccaaggttaaatttcgctttctacatggtggagtatgggttgatcgtattccagcattgattcgttatgcgactgttgatgcctctaaatttggagctccctatgatggtgttcattgggatcctcctgcttctgaaaggtctctttctactgtcctggaccacattgtaaacttaagcaatagaccttagcagacaaaaatatatgacaaaattatagtaccttttacctctggtttgcaggtacacatttaagcatcctcggccttcaaagcctgctgctccacgtatctatgaagcccatgtaggtatgagtggtgaaaagccagcagtaagcacatatagggaatttgcagacaatgtgttgccacgcatacgagcaaataactacaacacagttcagttgatggcagttatggagcattcgtactatgcttctttcgggtaccatgtgacaaatttctttgcggttagcagcagatcaggcacaccagaggacctcaaatatcttgttgataaggcacacagtttgggtttgcgagttctgatggatgttgtccatagccatgcaagtaataatgtcacagatggtttaaatggctatgatgttggacaaagcacccaagagtcctattttcatgcgggagatagaggttatcataaactttgggatagtcggctgttcaactatgctaactgggaggtattaaggtttcttctttctaacctgagatattggttggatgaattcatgtttgatggcttccgatttgatggagttacatcaatgctgtatcatcaccatggtatcaatgtggggtttactggaaactaccaggaatatttcagtttggacacagctgtggatgcagttgtttacatgatgcttgcaaaccatttaatgcacaaactcttgccagaagcaactgttgttgctgaagatgtttcaggcatgccggtcctttgccggccagttgatgaaggtggggttgggtttgactatcgcctggcaatggctatccctgatagatggattgactacctgaagaataaagatgactctgagtggtcgatgggtgaaatagcgcatactttgactaacaggagatatactgaaaaatgcatcgcatatgctgagagccatgatcaggtaccctgcattatataataactttataaggaagtatagttggatgcagcaaagtattttatttccttgtggggtagacaacacatggggcaagtatcttttaatcagacagtactatatttcatcacatttctatcctgattgctagtaactggattagttattcataaaaaattaggccctcctaagcatgtttaagaatttgcaatcacatatgacctgtttatcttatactggaaattaaaatcatgcaaattttcagtctattgttggcgacaaaactattgcatttctcctgatggacaaggaaatgtacactggcatgtcagacttgcagcctgcttcacctacaattgatcgagggattgcactccaaaaggttccattctcctcaagttctggttgaacctggttttcaataattcttgaatgagttccctcaatataccttgcttattgtgttctgtacactccagatgattcacttcatcacaatggcccttggaggtgatggctacttgaattttatgggaaatgaggtgaaatctcggtcttttgaaaaatgtttcccattaataagcctgcataaaccttttgtattttttttctatttgaggtttcagcatttagagtcgaccctctattttctcagtaactgaagttcctaatggctatttgaatggttaatgttaattccgagtagcgctcgttgcacatgaaaatgtggtctgtttatggctgctaatccttttgtgacttgtccaatatactcgtacaacatgggatacatgtaacccttcactattcaagcatactgcttaaatgtcaaacatcatacagagatattatcaagtctttctcctgcactatcctggaatgaaaaaaaagagttgtttcatatgctatctgtacttttacaaatgagtgtgatctttggagaagttagttgacggaatggtccactgtattttgtttgttatatgtttctccttattcatagtgtattcaattgatgtgcaattctcttctagtttggtcacccagaatggattgactttccaagagaagggaacaactggagctatgataaatgcagacgacagtggagccttgtggacactgatcacttgcggtacaaggttatgtctatgaatgcaatccttataagatttttgttctggcaccattctaggctctctttgacctttacctcttccatttatcgctgtctcctatactagctagatctgtctctgagactagctagatgtcagttccttactactattacactcttgagttgagctgggtccagatatgcttttccacactttgttttgctgccccactgccctactatagtaaattgcaccaaccccgtacatgttactcaataaacaggttggattggcctgtgcaaacctagtattttgtaagttgacctggctttatgtattgccattgttgaataaaaataattttgatgcattgattggtatgtcattttcataactttgcagacctaggaatgtacttctcaatcattggttgttttgttgatagaaattattctgtttacagcatatggtggactaaatatccaagtgaacgtttgttttgtctgtttttttttctacccctcaagtttacaatttatcccggctaacatattaatgttttctccttgctctaatgctgaacagtacatgaatgcgtttgaccaagcgatgaatgcgctcgatgagagattttccttcctttcgtcgtcaaagcagatcgtcagcgacatgaacgatgaggaaaaggtaaggatttcagaatacttggtatgagagtgttgcgacgtttctttctttcttaggaagagtggtaactctagcttgtgtgctgtattttgccgattaaggcgagcttcaatttaggagtggatggtttgtcagcattattttttctacttcgtttcaggttattgtctttgaacgtggagatttagtttttgttttcaatttccatcccaagaaaacttacgaggggtaagtcaccagttgtaaaaccctgtcttttcagagtcccttttgcctgtggtataatataatatagtgtgcttactcccatctctgctctgcaacttatatgcagctacaaagtgggatgcgatttgcctgggaaatacagagtagccctggactctgatgctctggtcttcggtggacatggaagagtaagtagtgacggtagacgctgaaagatgttttttttttttaatttttgccctactcccgtagttggggccggccggccgtcgagaatcgatcatatcaggctgtcgtgtttgcgagactcatggatgctgtgacgcaggttggccacgacgtggatcacttcacgtcgcctgaaggggtgccaggggtgcccgaaacgaacttcaacaaccggccgaactcgttcaaagtcctttctccgccccgcacctgtgtggtaatgttcacttactctcagctgaactgatgagctagaatgtatccgccctgacaaaccgtcctgctgccaggcttattaccgtgtagacgaagcaggggctggacgacgtcttcacgcgaaagcagagacaggaaagacgtctccagcagagagcatcgacgtcaaagcttccagagctagtagcaaagaagacaaggaggcaacggctggtggcaagaagggatggaagtttgcgcggcagccatccgatcaagataccaaatgaagccaggagtccttggtgaggactggactggctgccggcgccctgttagtagtcctgctctactggactagccgccgctggcgcccttggaacggtcctttcctgtagcttgcaggcgactggtgtctcatcaccgagcaggcaggcactgcttgtatagcttttctagaataataatcagggatggatggatggtgtgtattggctatctggctagacgtgcatgtgcccagtttgtatgtacaggagcagttcccgtccagaataaaaaaaaacttgttggggggtttttcttctactctgtagtctgttcttgctaggttgacgaagatgtttgatattagatgccatagatcatgtactgttaagtttcttcgttccttgttccctgtccagttcacatttgattccagctgttcagcaggccggtcagctcagctccacaccgggggccaggccggcgtcacgcaggcatcttttcatttcatgcgtcataacacaaacacttttgatcttttcgacaaaaaagatggatcgctaacgacctcttcttccaggtcttccaactcgagcagcgtcacgggcaccacaccactgggagcaccggagcagagcatcaacatccacgtggtgtcaagagtaaaagacttggaccgcttcaaagaagcctaagcctcggaccgatcacagtcacagaccatgtgcgctgtgtgtgtggctgaatgtcactggaagaaaggactggactggaatggaatggaatgcgacgatggacttgactgactccccccgtcccccggcaagcggcaacaacaacaacatccatccaccagcaacgacttgcgcagcgtcgtccatggaagaaccggtccaaccgacgggatgcgatgtcgatggcccccagctccgctccggctccgtttccaggtcttgctttcttgaacagtctctaaaatctgagtcagtatgttcttctgaaaggaacctatataattgatgattctagtttaaaatttaaaacaccatcattacgacaaagccaaataatagaccaaaacaatactttcattccaattagaagttttttttctatatgaacattcttgttagcaatccaattgccccatatataattaataatgatgggtctctctatatttagaacaaagtagataattgtctaaatatttctagcaaagtaacaataaaaaaaagatgttgaatcctctcattttgattacaaaaattgtatttcatactaccttttcacctgcacttagctaaattgtctatggtgg

SEQ ID NO: 732 - protein, 823 aa, Zea mays
MLCLVSPSSSPTPLPPPRRSRSHADRAAPPGIAGGGNVRLSVLSVQCKARRSGVRKVKSKFATAATVQEDKTMATAKGDVDHLPIYDLDPKLEIFKDHFRYRMKRFLEQKGSIEENEGSLESFSKGYLKFGINTNEDGTVYREWAPAAQEAELIGDFNDWNGANHKMEKDKFGVWSIKIDHVKGKPAIPHNSKVKFRFLHGGVWVDRIPALIRYATVDASKFGAPYDGVHWDPPASERYTFKHPRPSKPAAPRIYEAHVGMSGEKPAVSTYREFADNVLPRIRANNYNTVQLMAVMEHSYYASFGYHVTNFFAVSSRSGTPEDLKYLVDKAHSLGLRVLMDVVHSHASNNVTDGLNGYDVGQSTQESYFHAGDRGYHKLWDSRLFNYANWEVLRFLLSNLRYWLDEFMFDGFRFDGVTSMLYHHHGINVGFTGNYQEYFSLDTAVDAVVYMMLANHLMHKLLPEATVVAEDVSGMPVLCRPVDEGGVGFDYRLAMAIPDRWIDYLKNKDDSEWSMGEIAHTLTNRRYTEKCIAYAESHDQSIVGDKTIAFLLMDKEMYTGMSDLQPASPTIDRGIALQKMIHFITMALGGDGYLNFMGNEFGHPEWIDFPREGNNWSYDKCRRQWSLVDTDHLRYKYMNAFDQAMNALDERFSFLSSSKQIVSDMNDEEKVIVFERGDLVFVFNFHPKKTYEGYKVGCDLPGKYRVALDSDALVFGGHGRVGHDVDHFTSPEGVPGVPETNFNNRPNSFKVLSPPRTCVAYYRVDEAGAGRRLHAKAETGKTSPAESIDVKASRASSKEDKEATAGGKKGWKFARQPSDQDTK

SEQ ID NO: 733 - DNA, 10602 bp, Zea mays
tcagctgcttcttcacttttctgtagctgcgtctagagtctgagccaatgagttcctccaaataaaacctgcaaataagtcaacatatgtactttgttaaatattaattcatttctacttattcaaatagcacagcacatgctgagacaccataataatcaaattcttagtatttagatccatctcatcaaccaactccaaagatatgtttgacagttcttagtatttagggactgctgccgagtacgttccttcagatcctctttggttcttccttttctattttatttatattgtcactttactagaccatagtaagagagaattctcttttgtgttaattaaccacccacaccgtacaaattgagcaagcctttgttatctccacatacatgtatattaatataagatacatatatctcgtttttaaaagaaatatcgcattggtttattattttaagactagtttgtaaactctatttttctgagaaattcctatttttcaagagaaaataaactaatttctttgaaaaaatgtaaaacttttgataaaataggattgtcaaactagaccttattatatgtatatgtatatgtataaagtatcactgtgaaagtatgaaaaaagtttagttcttttcttttggtgaatataagagtataaataataaaaagtggaatagtatagtgcctgaaaagcggcaactagatcgtgtttgccagtacgcgggccccacagaaaaagcccacgtccgcctcccgctgcgaaaaaacgacacgggccgagtggacgacggtggccggacgcagacgcagacgcttccggctgtgaaaaaacgcacgctccgaccccgccgtccgccgatccgaggctccggccccactctgtcagcgtcactgcgtgagcgagcgggcggcgtgcgtgatccggacccgcccctcctcacaccgtcgcgcacgggagccaagacgagccgcgctccgtcgcatccacctcgtctcgtcacacactccactcgaacgcactacttgatcggccaaagccaaacgaactgggctccctcccctccacttcctctccccatggcgcagcagctcccctgcgtctcgtcgccgcgcccgctgctcgccgtgcccgcgggccggtggcgcgccggcgtgcggggccggcccaatgtggcgggactggggcgggggcggctgtctctccacgccgccgccgcgcggcccgtggccgaggcggtgcaggcggaggaggacgacgacgacgacgacgaggaggtggccgaggagaggttcgcgctgggcggcgcgtgccgggtgctcgcgggaatgcccgcgccgctcggcgccaccgcgctccgcggcggtgtcaacttcgccgtctactccagcggtgcctccgccgcgtcgctgtgcctcttcgctcccggcgacctcaaggcggtgagcatcccccacccctagtctttgatgaatgcaatttctgcaacgcgtgctgcgatccttctgtgtcgttcttcttctcttttggaatttgaatggaagggaagtcggcttcataacttactcctctatttctctctctctcgaataacttgcttctccgatgctgtacgctaatttgtttggcttcatagcatacgccggtgctgaaatggactgagttctctgtattcctggtatgatgcaggatagggtgaccgaggaggtgcccctcgatcccctgctcaaccgaacgggaaacgtgtggcacgtgttcatccacggggaccagctgcacggcatgctctacggatacaggttcgatggcgtgttcgcccctgagcgcggacagtactacgatgtgtccaacgttgtggtggatccatacgctaaggtgacgggctgttgtcctttactttggctatgcgtgtgagctgtgacacactcagaaactgattgctgggtgcttgctcatgttttagttgtttacttcttcttgttgttgttttctctaggcagtggtaagccgaggtgaatatggtgtgcctgcgcctggtggtagttgttggcctcaaatggctggtatgatccctcttccctataataaggtaagccagaactactctcgctcacactaccttcctgtttgctttcatgctgtatccttctcttccagttttatgtccccatgtctgactcactcacgattaaacaataaaaagaaaccaccgcatatatttggtcattgatgatttgaaaagtccgatgaactaactgaacaaagcgctagaactatcaactgtaggttaggatcattggttctgttacttagtttctcgtttgcaggttcaaatggagtgaagttatatttactgcgtattcatgttgtctttgttatttcatttcgtatgataagggtttgcatttgcagtttgattggcaaggtgacctaccccttgggtaccatcagaaggaccttgtcatatatgaaatgcatttgcgtggattcacaaagcacaactcaagcaagacaaaacacccaggaacttacattggtgctgtgtcaaagcttgaccatctaaaggtactgttacgaacagactagctataagtctgcgaaagtgtcctcatgcatttgtttaggttttgcaactatgccaagtaatgctgccctagtctattagttcataggcataaacacagattttactttgtgcttacataaatgtttttgctcagtaaacttgtcagtggtattggtcgtcttagactttttggcatgtgtttgttgttggaatataatataagtgaattgtcaaccttctcctatcagcttaagcttttggatagaaagaattggttggtgcatgtaacttaatatggtattaaagacagaggtcatgaattcgaatcctgactagcacaattaaataaaacccaaaagcttaagcttataggaagagatggataattcacttatattatattctaacatttatgactaaactctttgtttgacctgcataaactcccttcacaggaacttggagtgaactgtatagagctaatgccctgccatgagttcaatgagctagagtacttcagctcctcttcgaagtatgtggatttggattacagtatatagatgccatcagttttataggactctggaactgatatctttttgtttcattgagcatgatcgtatatgaccttttcgttctattttccatgatatttcccccatttccagatttgctagtgtgatctccaattttgtgccttacccttatagcttgatcacaactgacttatattcatatattgacacattatttcatataattgttcatccttgtgccaggatgaacttctggggatattccacaataaattttttctcaccaatggcaagatattcttcaagtggcataagagactctggatgtggtgccataaatgaatttaaagcttttgtaagggaggcccacaaacggggaattgaggtaaccaagccaatttaagttaatggctgaatgctaaccgaaataagagcttccttatatcatttttgacatggagatatgtcactattaggtgatcatggatgttgtcttcaatcatacagctgaaggtaatgagaaaggcccaatattatcctttagggggatagataatagtacatactacatgcttgcacctaaggtgagatacattattcatcttgtaatcgttctttcatggaccacaaagtatttatgtattccatttcatagattcacgtctatataacaagctatttgaagagcatttatttgtgcagggagagttttataattattctggttgtggaaataccttcaattgtaatcatcctgtagtccgtgaatttatagtggattgcttgaggtacaaatctgtatataacttctgttaaattgctcctaatttccttctgccgcttgtcattctattggatgatgcaagtttttgagggatggatagcaatgtttatgctttgctgcctgaatatataagcattttaaatttctagtattcaaacaaaacaaagaaacaagttttctttaattgatatttcgtcattgactatcagtgtttaagctatatatttgttaagataaattgtttatgcactaatatttgagtttgatgttgcagatactgggtaacagaaatgcatgttgatggttttcgttttgaccttgcatctatactgaccagaggatgcaggtaaaatgttattcttattttctccttattttgtctttttaggcatttcttaagccaacctttcctttaccagtctatgggatccagttaatgtgtatggaagtccaatggaaggtgacatgattacgacagggacacctcttgttgccccaccacttattgacatgattagcaatgacccaattcttggaaatgtcaaggtagctgttatattttatacttatgttttattttttttctccaaaagcgcaggagaactgcgccccattatatattaagaagagagaaacaaaggtctatagaagacccagatacaagactctccttacggaggccagaaacaagcatacaaaaaactgtccataaagacactaaccctcccaacatctgcccctaagcattaggaagcggagccaactacattcggggccctagccaggtctagtgagcctagatttttagctccagccataacccaacatacaagttcatctaagaagcttctctgtagtcttgctagtgaaggagattccacattgaagattactttgttgcggtgaagccatacacaccatgcccccagaatgatgacactgttgagcccctttttcctacttttgtgccctctaataaccagacgtctccaccactccgcgaaagagggttcatcaacagcaggagtaaggtggcccaagctgaaaggagataaaatactgaaccaaaattgacgggtaaagatgcatgaggttaggaggtactgaattgtttcctgttgttgatcacataaggagcaagcatctggatgtggcaaacctctcttttctaacctgtcagcggtccaacacctattcctcatagccaaccacaggaagaatttgcatttcggaggagcccatgtcttccaaagccttttccatggctcaaaggtggttgaacctgagaataagatttttcaacaagatttagacgagaaattccctgagatctcattcctccacctgtgctgatcaggaacttgggataattcaaccccctcactgaatcccataacagcaggtactgctgcagcccagccagcgagagaggtgctttaatatccctaacccactgccaattttcaagggcttgagccacagttcttgaatatagaaatattttgcccaccttagctaccacctcaggggcaaaatccctgatcgcagccccatttagccatctatcagtccagaaaagagtgctggtgccattcccaaccatagaaatcagagaatctgaaaacagattcttgacatgctgctgtataggaagcttcagtccctgccactgccaaggcctgtttgggtccatttttttccaaccataaccattttgattgaaaagcccagctcatgaattgcagattagggattcccaagccccccaagatcaataggccttgtaacaatatctcaagaaaccagacagctgcctccattagcctctttccttctcttccaaataaatccccttctaattttgtctatagctttaatcatccaattgggaatattcattgcaataagaagatagactgggatagccgaaggcacatatcgcacaagagctattctaccagcaaggttaagaagatgtgctttccaatttgcaataagaaggttatttggttgattatgattcttaatacttatgttttatcatctgcactaactgaagattcaaagccattttgtggttttggatacgtgtacacatgctatgtaactaatcacagttaccatgtgcttgatgcttttgggtaatatatgaacctgattggctgttaaatatgcagaacagtatatataatattcgactgtatcaacatattgtagtttcttggtttttgttctcactacttcctccattgtatttatagctcattgctgaagcatgggatgcaggaggtctctatcaagttggtcagtttcctcactggaacgtttggtcagagtggaatggaaaggtaagatattttcagagacttgaaagtctttttgctacttggtactttctaaataacaaatgaagccttgtcaaatactgaatgtaagtttcaacagatatatttaaatagatgagtgcttctatctacctgtgaattgttgcagggatctaaaactgtttaaaattctaacgttagtttcttctagaggcaaatcggtaatttggtctggtaagtggatacagtttggaataatggatggaaccagaatctacgttcaggcccaactatcaaacagactcagggctgtttgggggcaagttccagttccagttttcaagcttctgaagaagctggctccaaggaacctgagcctaggatacttggatctcatcattctgttttttgttctagagaagctgggttcagaaaggccaacacttaggacttcccagcccaactgtttttatgtgggttgagcagagaaaagcccagctagacagaaaacacaaataactgcatttgttggacttatagaattttaaaattataaacacaagaatgatttttgagatatacttcacaggccaacacttaggagtatgtttcaaacaatagcctcactgacaacattaggtaagtgcatctttgatctttatcagagcatgatgctgatgaagttttgataattaccatatgatcttttgcatccttcttcagctaaaccaacagcttccaactttttgttctttatagttgtttcaccaaagtactaacttgcttagttgttttctcagtatcgcgataccgtgcgtcagttcatcaaaggcacagatggatttgctggtgcttttgctgaatgcctatgtggaagtccacagttataccaggtaatgtaccataagtacccatcaatgagcacggtgctacatgacctgaacagaaacttttgaaggaactgggtgatagtgttacagataaacagaaataacataatatgacaatatagcatatatttcagcctagaagtttaacacaagttccattctatgtagtagtataacctttaggatccaatctgcgagtgagagatcacattcttttctttgagtgtctaattgacctcttcaagccattgaaaactcctactatatatgtattttgttggatgagaagccgcatgaataaatactatcttcatgtagaactgatgaaagcattaacaatgaattgccgaatactccatgtattgtatgcaattaggtggattagtgtttatctacaaataatagtttggtattgataagtacatgccttttattatcaggcaggggggaggaagccttggcacagtatcaactttgtatgtgcacacgatggatttacactggctgatttggtcacatacaatagcaagtacaacttgtcaaatggtgaggacaacagagatggggaaaatcataatcttagctggaattgtggggaggtaatttgaaatctcatgcttttatctcttgtaggctttttatgttagtcaaatgtctgtcaaatgacttgtcatagttttctagccatgagtaccaaactggtttcacctaaacaggctatatagtttgtacacgtgcatttccagctaaatttatgtggcaagtatatacagatcatctctatagtgtagcgcactttagagtttcatttgaataatgcaggaaggagaatttgcaagtctgtcagtccgaagattaaggaagaggcaaatgcgcaatttctttgtttgtcttatggtttctcaggtaagaattagtatttgatgttttaagttttttatggattgtgctttcaggtccctgtttgttcagggtagaactcaaggttgcatttgtagtcagtggtatgctggaatatgcatcattggttcagtccttgagtttagtcacttgatgagggttactacttgctaggttgtgtgaggatctgtgttttccaaaagattatgacatgttgcattgaatatccaactagctgtatttgtacctgggaaacatagttatttaaccaaaaattactgtaaacatcatttatttgacaaggtttcagtctttccctgcatcctaatataggggtaaggttaaagtggatctgaagtcacattgttatttttttgtattgatctactactacctagtcaattgttttcattttctaaatttttagggagttccaatgttctacatgggcgatgaatatggtcacacaaagggagggaacaacaatacgtactgccatgaccattatgtcagtccgatgccagcacatattaacacattgttttaatcaatttctttgacattcttgtaatcttctagccttttattttggttgtgcaggtcaattatttccgttgggataagaaggaagaacaatcctctgatttgtacagattctgccgtctcatgaccaaattccgcaagtaaatactcttcccgccaaatagtttccgtgctaaaccgatgatggttcctctgttcaccaaatggcgagatcctgtacagtttacgttgtcatactgtctattcatgttctgttggtgtgcaatacagagaatgtgaatctcttggccttgaggacttcccgacttcagaacggttgaaatggcacggtcatcagcccgggaagcctgactggtcagaggcaagccgattcgttgccttcaccatggtactgacataacacctaccaccatcatcactagtcatttcaagaatcgtttttctaccattaagtagatcagagagagatcgaaaaaggagtgatgatggtttcttatgtatctgttactgcagaaggacgaaaccaaaggcgagatctacgtggccttcaacaccagtcaccttccggtggttgttgggcttccagagcgctctgggttccgatgggagccggtggtggacaccggcaaggaggcaccatatgacttcctcaccgatggcctgccagatcgtgctgtcaccgtctaccagttctctcatttcctcaactccaatctctatcctatgctcagctactcctccatcatccttgtattgcgccctgatgtctgaaagaagcagatacaatagagtatactatagcggttgttctctaggctgtagcatgcagtggaaactggaaaatgttggggttgctctgttgtcggtagtttacatgcgcatgtcggtatgtgtagctaaagctggtggatctcagttctcagatcggactcgagacggggaaaaccattgcccagttggctggttctctgaagttttgtttggtgtaaagaaatggtggtccatcatctactcaaatttttttctcttttttaatgaaataagttgactcaaaatcaactcattcttcaacttaataattagtatatacacaaggaataaattaattctatcaaatttatgaaatgaaatccaacattattcgaaggactgacgactactaacacggcactgctcccggagaaagaggaaaacctggcaaatggattacgggtacgagggtcggctaaagtaaagagtacggacaaaactttcatagcataggctcagagcttacgttgtcattataggcgatactgtcctaccaactccgccgtttgcgctacaaacttcaggtatccttggtcatggtcacataccttcgaaggtatggagcattgtacccacgtaaacaacccagagtatttttaaccaaagtacgttggcaagaacgaagcacagtaccaacacgcttgtcaacagaagaccctttttacctttctacacactccctaggggagatccttgtaagaggcatcttccttgagctgtaaaaggaagggttggtcttctctattcagatgagacacacactccgacccacgcacgcacgtactcacaccagagacttgggaacgcttccctctctcgccagcttgcaacctcgtactacgaataatttggtgttggtagtgtaagccaccgaagactagagtagggatattcggccgaaccaatataattcatgcgtccacatcgcaaaccacccggcctaacgcgcactacaaatttattcgtcggtacttactcgaaacatcgccactaaggccagggttcaagcccaatatctaacgctcccataccattgttaggtgtctaggacattggctctgttgggggccttcctctttcgaaggtcctcaaaagtgcgactaaccatttgttttcagtatgatatagattattacaggaagcttcatctttgggatgaaagttctctcatgataaaggcatgtgatatgaatatacaacccgaaggtgacatggatggacgccgaagctatggctcaaggagct

SEQ ID NO: 734 - protein, 789 aa, Zea mays
MAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLYGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 735 - DNA, 7816 bp, Zea mays
ccagccccagtccacacctcgcggcacgcccgatgcgagtgccgtttggcgcgcctcatcatcgctcaccgtttgggggcctgcctctgcctttctgttcttcaaacgatgtctcatgtctgcgctggacaactttcttgttgccgcctgtcgcttgcgctgtgctgactggacgcagctccggaggtttggttgtgcttggttttcgtagagaactcgccacttgccgcccgcacgttcttggtgtttcctcctccccgctgtgttctgcgcacgggctttttctgagagacccatgtttcccttttacttttataaacagtatacatgctatgtttctagaaggaggggaaacctaatccccctaatccaatggcggggaggaaatagggtggggtggggtggggggagggaaatatctcgctactttttaatccggacaagctcatttgcgtttgcgtctgaatgatgatgactgcaatgctgatcgcacctcgggtgtcggatcaccagcttttggctgctctcaccaaatcagctgcaagaagattagagctcaaaagaattacagaaagagagcctttttcttttcttccttgtggggttcctttcatttcgtgctctcctttctctgccagccagtccgtccttgcgtccactgcacctgcacacaggtcaccccgacccgcactgttctagactccattagaaaaaaaaaggtctgaacctttccgaaaccagccagccattggtctggcaggccagcatatgctaattggatttttttgccgcatcattgagtgcgccatcaggatttggaaatcctggttttgagtaatacagtaatttggcattatccattgccgaattcccaagctccgtcagcttgaacgtggacccctaccatctgcaccagctcggcacctcacgctcgcagcgctaggagcctaggagcagctgcccgtctatttattggtccctctcccgtcccagagaaaccctccctccctcctccattggactgcttgctccctgttgaccattggggtatgcttgctgccttgctctcctgttcatctccgtgctaaacctctgtcctctgggtgggtttttgctgggattttgagctaatctgctggtcccggtagaaaagatcatgtcccctgacgagctcaagcgctcgccttagccgcgtccttgccccccgccattttttgcggtttcggtgtgttcccgtgactcgccgggtgcgtcatcgcctgaatcttgtctgggctctgctgacatgttcttggctagttgggtttatagattcctctgatctaaaccgtgcctgtgctgcgcacagaactctcccctgtcctttcctggggttttggttacgtggtggtagtaagcttggatttgcacatggataaagttgttctaagctccgtgggttgcttgagatcttgctgttattgcgtgccgtgctcactttttttgcaatccgaggaatgaatttgtcgtttactcgttttggtggattattagcgcgaaaaaaaaactcttttttttttgttcttttactacgaaaagcatcttcttggattttgctatcttcttttactacgaaaaactcttgagtctaggaatttgaatttgtgatgtccattcttgcagtgcgctgtgctttattgggaagccaaatcctattattttctgcctctagggtctgaatggaatcagtactcttgagacagaaaatcaatccaatcaagttgatttctttctttaaaaatattatcacagaactaagtgcttgtgcggaatcagtactggcttttgtttggtggaggatcaatacttgcttttgtttgggggtggcaactgttttgctataagattccatgtgttcctgttgagatgaatcatatatagtatagctgcatactacaaatctgtttttcaaatttaggttgctttggcatgatctatttttttgtcagacagactttctaagtggtagctcttgatttcttgttcttgtacaactggtgctgctgaatcttgaccgtatagctcgaattgcagtattctgaaccatcgagccatggctgccaagctgactcgcctccacagtcttcgcgaacgccttggtgccaccttctcctcccatcccaatgaactgatagcactcttttccaggtgggcttaccaaaatcatataacttgcatttcattcggtactgaaagttgttaatttgttattctcttcatgcctgtcttaatagcacacccagatgtaaacacgagattatgcaacttcttacttggtttcttttgttggcaccatcatgcatgctaattgctaaggatgttacctattcatccttgactcatattatcatatgtaatgattttatgatctcgagactattgattgtgaagcatagtatagctgttcttcagtttttgtacccttttgtttttttccttaagctagaactggtacaatttagttgataagacagtgtagtttgtagtacgtcatttgacagattgtttgtctttagctggtaaagtgccatttaatatctgtatccttcagatctaataaaaaggatatgagatgtccatcacaagaggggaaaaattacatgatctgagatgtaacatccgtttttatttgtgaaataccacttctacaggtatgttcaccagggcaagggaatgcttcagcgccatcagctgcttgcggagtttgatgccctgtttgatagtgacaaggagaagtatgcaccctttgaagacattcttcgtgctgctcaggtaacactagcactgctgagatgtctgcttgagtgcttgccaattgaaactaaggtactctttctaatttcccttgtctgcatataggaagcaattgtgctccccccatgggttgcacttgctatcaggccaaggcctggtgtctgggattacattcgggtgaatgtaagtgagctggctgtggaggagctgagtgtttctgagtacttggcattcaaggaacagctggtggatggacagtaagttctttgatgaattgtttgtagtctttagctatgtctatattctagttatactaattccagtccttttttaccagatccaacagcaactttgtgcttgagcttgattttgagcccttcaatgcctcctttcctcgtccttccatgtcgaagtccatcggaaatggagtgcaattccttaaccgacacctgtcgtccaagttgttccaggacaaggagagtttgtaccccttgctgaacttcctcaaggctcataactacaagggcacggtgagcttccacagtccagagtcttttaagcacatgcttcacaatggatgatgtcaatattttcttactattatctaggaacttcacataacctgaaaatggattaaatgatgccatctgattatttctaactgctgttttctgttacagacgatgatgttgaatgacagaatccaaagccttcgtggtctccaatcatccctgagaaaggcagaggagtatctactgagtgttcctcaagacactccctactcggagttcaaccataggtgaatgctcaataaaacgttctgtacttgctatggaactttggttgaaatatgacaaatggattaactgcctataatgccactatgatctgtgttaggttccaagagcttggcttggagaagggttggggtgacactgcgaagcgtgtactcgacacactccacttgcttctcgaccttctggaggcccctgatcctgccaacttggagaagttccttggaactataccaatgatgttcaacgttgttatcctgtctcctcatggctacttcgcccagtccaatgtgcttggataccctgacactggcggtcaggtacagaagcttagtgattactatttcctttaggctttgtttgggtatagagggattgaagtgaattgaggtgtattaaagaggattgaaagaaaaattagtttatattacacttcaatacaccacataccacctcaatccactccaatttgagattacccaaacaagcccttagctacttcaccttccaggtttctcatttgcgatcgctttgcaggttgtgtacattctggatcaggtccgtgctttggagaatgagatgcttctgaggattaagcagcaaggccttgatatcactccgaagatcctcattgtatgtttgagcccacgtttcaccttctgaatcctttttttcactgtgccttgatttactcagtaaatgtgcctacatgatcttatttgttgcaggttaccaggctgttgcctgatgctgctgggactacgtgcggtcagcggctggagaaggtcattggtactgagcacacagacatcattcgcgttcccttcagaaatgagaatggcatcctccgcaagtggatctctcgttttgatgtctggccatacctggagacatacactgaggtataccgattatctgactggatgtcctacacagcatagcatgtttgagtaaatactgaagccatgcattctgtgctgcaggatgtttccagtgaaataatgaaagaaatgcaggccaagcctgaccttatcattggcaactacagcgatggcaacctagtcgccactctgctcgcgcacaagttgggagtcactcaggtctgtctgtttggttttacatgagtatttgagtatctttaaaattattaagttattatttcaattgcttaatggttttgtacatacttgcagtgtaccatcgctcatgccttggagaaaaccaaataccccaactcggacatatacttggacaaattcgacagccagtaccacttctcttgccagttcacagctgaccttattgccatgaaccacaccgatttcatcatcaccagcacattccaagaaatcgcgggaaggtagaatttgtatattagtatcgctgtgctttagtagtaaataaaactagtatgtgatgttttctgtgttgtttctgcagcaaggacaccgtggggcagtacgagtcccacatcgcgttcactcttcctgggctctaccgtgtcgtccatggcatcgatgttttcgatcccaagttcaacattgtctcccctggagcagacatgagtgtttactacccgtatacggaaaccgacaagagactcactgccttccatcctgaaatcgaggagctcatctacagcgacgtcgagaactccgagcacaagtgagtatactgaaaactggttgcatgtcttactgcagccaatcagcttgtaaatactccaacacccatcgcatgatctatccatctttctatctgtcacctgagctgaacacctggtgtttacttgcatccaggttcgtgctgaaggacaagaagaagccgatcatcttctcgatggcgcgtctcgaccgcgtgaagaacatgacaggcctggtcgagatgtacggcaagaacgcgcgcctgagggagctggcgaacctcgtgatcgttgccggtgaccacggcaaggagtccaaggacagggaggagcaggcggagttcaagaagatgtacagcctcatcgacgagtacaagttgaagggccatatccggtggatctcggcgcagatgaaccgcgtccgcaacggggagctgtaccgctacatttgcgatacgaagggcgcattcgtgcaggtatatgcacacacacacacacacttgatctaatatctaacctcccaagttcccacaacggtgcaatctactttcagacaacaacagtcactgaatcatttcatcactttgttttttttttgtgtgggtagcctgcgttctacgaagcgttcggcctgactgtgatcgagtccatgacgtgcggtctgccaacgatcgcgacctgccatggtggccctgctgagatcatcgtggacggggtatctggcctgcacattgacccttaccacagcgacaaggccgcggatatcctggtcaacttctttgacaaatgcaaggcagatccgagctactgggacaagatctcacagggcggcctgcagagaatctatgagaagtatgcatttttctctcctgccatacaatgtaaaattcttgttgcctgaaggcgcatctgttttactcccacggacactcggaaatctgctgtacccttatctagttaggaggagtggtagtaaaaaaaatcctgacactacaagctttggattgctcaggtacacctggaagctctactccgagaggctgatgaccctgaccggcgtgtacgggttctggaagtacgtgagcaacctggagaggcgcgagacccgccgctacatcgagatgttctacgccctgaagtaccgtagcctggtaagccgtttgatgcctgcctctgcctctgcctctgcctgccagagaggatcacgtgttcgttcccattccagcagtcttaaacgagtgaatgaactactgacgcatctctttctggaatccaggcaagccaggttccgctgtccttcgattagtacggggaaagaagaagaagaagaagcccaggccggagaaccatcgcctgcatttcgatctgtttcaccgcaattcgcattgttagtcgtgtattggagttatgtgtacttggtttccaagaactttggttccttctcgttttttttccttgtttgagcgtttttgggcagcgctggcctggttcctagtatggtgggaattggctgcaccttttgcttcgaataaaaatgcctgctcgttcacctgtcttccagagtgcaatgcgatgttctgttgcccaggtcgtgtggttctgactgatggcgatgttgtgttcttctgttaatcgcctgtttaacgtggtaggctgatgcttcttgttgagaaagcttgctgtgccagacatggctgcttgaatacaagtgaaggaaaaaaaaagccatgccaagtaaagttgcacaaaatttcaactgctcagtggaccactggaccatgttcttggttattgcagttgcagggcttcacatggcgtttggacagcagtcttggattgatgcataaagaggtggtggttaatgaggacgcaaggccgttccctcagagtcagtcacaaggttgcagagctcacggttctcttccctttccgcttcctgtcacatcggaattgttgtttacgccatctgcccatcacccaccaagtctatgtttctgtactggatctttcaatggcggaacgcgcttagttcttcgtcacagtcgaatcacatgatctaatcgatgtctttaatctcgctgtaaaaagggtgggacggtgggtgcagggtagggaccagggaaggcctgcctaaacgtatccataaacatgcacagcaaccctaagatattatactgcctacttcctaagatatagttatttctagtctattttttttccgtccacatccaaataagtgataatatatagacatacatatatatactatattcatcatagattaatgaacgaatgtatacttagtttaaacctaattatattttaggaaggatggagtatgaaacatgacaatacaacaaaaaaaaatcatgtaattgcatatcgtcaaagttatctgaagtaaccaatccagggggaaatcccgttagcaaacatacaagagcaccgccccactacatcccagaaaataaaacaaaaccagaactcagatggataaataatactaccaaatagggcttggaatttagaagctctgtttgtacttgaatatgctgcattaaatacagaaaaaggttccactttccca

SEQ ID NO: 736 - protein, 802 aa, Zea mays
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRVNVSELAVEELSVSEYLAFKEQLVDGQSNSNFVLELDFEPFNASFPRPSMSKSIGNGVQFLNRHLSSKLFQDKESLYPLLNFLKAHNYKGTTMMLNDRIQSLRGLQSSLRKAEEYLLSVPQDTPYSEFNHRFQELGLEKGWGDTAKRVLDTLHLLLDLLEAPDPANLEKFLGTIPMMFNVVILSPHGYFAQSNVLGYPDTGGQVVYILDQVRALENEMLLRIKQQGLDITPKILIVTRLLPDAAGTTCGQRLEKVIGTEHTDIIRVPFRNENGILRKWISRFDVWPYLETYTEDVSSEIMKEMQAKPDLIIGNYSDGNLVATLLAHKLGVTQCTIAHALEKTKYPNSDIYLDKFDSQYHFSCQFTADLIAMNHTDFIITSTFQEIAGSKDTVGQYESHIAFTLPGLYRVVHGIDVFDPKFNIVSPGADMSVYYPYTETDKRLTAFHPEIEELIYSDVENSEHKFVLKDKKKPIIFSMARLDRVKNMTGLVEMYGKNARLRELANLVIVAGDHGKESKDREEQAEFKKMYSLIDEYKLKGHIRWISAQMNRVRNGELYRYICDTKGAFVQPAFYEAFGLTVIESMTCGLPTIATCHGGPAEIIVDGVSGLHIDPYHSDKAADILVNFFDKCKADPSYWDKISQGGLQRIYEKYTWKLYSERLMTLTGVYGFWKYVSNLERRETRRYIEMFYALKYRSLASQVPLSFD

SEQ ID NO: 737 - DNA, 2573 bp, Zea mays
caatgacagagagggtggtgcgaccatttaaagctcgaatgccgctaggggtgctcagggttaaatgatcaggcatcagggaggaaaggaagggataaaatttctttactctagttgtggggtgatggggacaagggcagtgctcaagcaagggagggcgagttcagcgcagagatgcctgtcgtgacacgtggggggtgggagtgggaggttgaggttaacaggtggggttatggcgtcagcgagagagagagcgactgagggggagagaagtgccaacaggtggggacgaggtgtcagtgactcacgggcacatgttagtggtaagtgaggtcgggaatggtttgggctgagtggatctaggctggctcggacactgtgctgattcttttatttttctccatttcccaatttaagtttgaatttttaattcaaatcaaatgaactccaaatctctccaaaaattacaaaaatctagaatatttagatgaatatgttggtggagtttgggctccgcttttggttagtatgtttgtataaaaataatttctctccttttgtcacttccaatattgacttaaatttttatgtagcaatgccaactttttttagtagtgtgccacttatagcacaaaaactatatccattttctaataatccttgaaatccacattctatttttagccattcttcaaaattggcacaaaactaggaaaatttaatacattcttgccataacatattctagtgcaaatgttaactagattgctcaatattagcaaacttcttttggaagattcattaatattgctacattgcatacttttttagaagttcatcaataatgcctcattatcatacttcattttaggaacttgattaaaaccgccttaaaatagagccaagtgacggatccactttaaaggtgattcttaatttcttacttcctatctttggtggcttatgtttatatatgtgtgggtggttgaatgatgttcctacaccactacaccacaccttggacatatatatggaaaatagcttcacagtctagattccatggcatcaaggatggggatggtggctattctgtccttgtttgtttgtgctcttgttgcttcaacatctgtcaatgctaatgtgtggcagactgatgaggatgctttttatagtacaaataaactgggagtcaatggcaacatggagatggcacaacaacaaggtggatttattggccatcgcccaagacttgcattattcaatagggcatcaaaacaactggaccgtgaaaaaagacctgtgcctagcgggccagaccccatacatcacagcatcccatcacatgctcctcagcatccaccatcatatggcaaagctccttatgaagatgacaagagcatagcatctcctggtctgtccaacccgataggtcctccaccatttttagatagatactagttcatgcaaaagtagtgagtatttatgcacctatgccaatgaataacctctaattacctacatgtattggcctggtgtttggtaaacatgaagcaataactttctcttatcgaaatactggtctcaactccgcctatgttgtctcagcatatgttagtgcagcatagtctggccctaagtctaggtactaggaggagggttgagttaggcacggtgagctagctataaaaaacttagccactccaatggagatgaaacccaataaaacagttggaggtgtaaaccccatagagacgcgctataccggaatccacgtatggtgttaaatgggcaagggccgagctgccaccccttggtggcgcaccgtgtcttgatatggatgcagtgtcaagtaagcaaggaatgggtcgtctcttcctttgtggcgcactacatcgacgtcttggtgtagtgacaaatgtgcaagtgtaacaccctaaaatcttaacttgtgatttaaataaatcatttaaaaaagtatctataataataataatcatcaagataaagtacccttgaggaataattaaactttagaatccaccctttataaagtgattggtcataataaaataatgttagctaaatcatatcttgataacgatttagacatttgaaaatgttttctattaaaacaaaggaatcataaattaaaatttgaattcaaattataaatgagaatgtaaaacataaaatgagtaaaaagaaatgaattttgattaagtcaattaccctctccataattaaataataggaagaaagataaataataaaaatgcaaacagtagtagtattattcagattagaatcatgtcagacatttggaaacctaaaattcaaaacaagaaattaaaatttagtttgaatctttaaatttggaaatagaaaagaatagaaaagaaaaataaaaagggaaatcacccgtattgggccgtgcgactggaattcggcccaagttcgtatcagcccagcggtctcactctcaccagccggtgggacccgcaagtcagccaccccacgcgcgctatagcatcaccgacatgtggacccgaccgccagtcgccctaccgcgctcg

SEQ ID NO: 738 - protein, 128 aa, Zea mays
MGMVAILSLFVCALVASTSVNANVWQTDEDAFYSTNKLGVNGNMEMAQQQGGFIGHRPRLALFNRASKQLDREKRPVPSGPDPIHHSIPSHAPQHPPSYGKAPYEDDKSIASPGLSNPIGPPPFLDRY

SEQ ID NO: 739 - DNA, 2898 bp, Zea mays
gtaacagaaccgatgaacacaaagacatgatttggatcgcgagcaccgcacctggtaccctccacctctcacgaagtatcaaattatcactggaattcaggattcaggttacaaaggaagagtcctccctttctgaacgcagtcggcctcaacttatgccccaagccgccctttgctgttcataaagtccttttctttataccacatgccaaaacaaaaagaaaacgcttaaacactcattgggtccaatctggcccatggacacgagagttgggcttcacttgacatcgaaccctcctagtagccatggttccttcccgccttctgttgatttcctccggtgtcgttacatatcgctggaccacattctagacgtccatacaccgaatatacaggaaagagagacaacggggtgaaccgttggacacggcctggaaacaacagtggcggctggaaacaacagcagcgactgtgacaacgactaaatagggttgaaccgcctttgccaatgattttttttgccgtttaccctttgccgagtttgacactctgcaaaaggtttactgtgtgcatttctggctttgccgagtgcatggggcactcggcaaagcatgtgactctggtagtgtgtatgctatgtagacgtacctccaagcttaggtatgtttcttcttagcatttatggattaaggtctaatatcttcttattagattgcaaaataattagtagtggaagaacaacaattgcaaatatgttggctgtgtttgtatgactaaacaactatgatcacatcataacaacaacaatatatgataatatctatatctataaatatatctatatgtaaagtttctatatctccatcattatctataactatatctacatgtaaaatttctatatctctatatctataactatatctacatgtgaaatttctattctctatctctatatttgtatctatagctagatcttctggcacaaacgagatgtgctagagatggattcgtcttctatataagtgagatcgaagacggagattagaacaaacagagcatatattccctcttcactagctcgtggtaataagggaagcttgatcatctttccttatggcggtgatgaagagcagcacaatcgtcgcgcttctattggctgttgccattctgtcctcactgtctccatgctacgaagccggcggctgtaggcgccttcgatctctacttctaagggcatgtacagtggtgtttaatgtgggggctcttaaggtgttttagggggttatttgcaaaaaaatcttagagccgtctctccgtgaagagacgcatctggctcgtaaaccaagtaacaacagacgtctcacttcccactgtacgaatttgtcgtctgttctatcgatctgatgctatacaaatacatttaattctgtatttattaatagactacgtttatagacactccattgtacaatagagtctcttagttgtctcctgtgcttggagaaccgtttttgtgtctctccactatacatgccctaattacttacgcaatagttactatttcgttctaagagccggcgataattatctattaattaaccggccgatctcgtttggactgcgatgtgtgtgcaggcatcgggaaacccaagaagtcaccgccgccgccgagaaggccatacttctcgtcctattccgaggaccaccagaactgccgcttgatctgtagctccaagggtttcaaggacggtggctggtgtgacgaaagcgtggagcacaaagtgtgctgctgctcccattagaaatataatagcgtatgttatgttgatgcatatatatatgcatcgtccatctacctgtgtggtgcaaaattctgaataaaatctggcttttttccggatgtcctgaaacgaaacgtggcaaattatatggagcaaaaggtttaggaaaaaagaaacgtaagatgtcaaaggaacacactgcacctacgtacattgccattattattattattattattattattattattattattattattattattattattattattattattattattattattattatggaactaaaacagcgtaaaaaaaggttgaaaaaaatggtacagatcttgcacttctcaaaatggagctgtcaaatgcttctctgagatccaattagtgtatttcttattccctgaatagagcaatatgcatctctgaatttgcagtagtgtatcccttcttgcctgataggttctatccaatcttgaaaattgaattttctatggtgtagtcgtaactgaagtgtctgtgcaagcatgatgaattttatttaggtgtgttttggtcggtaacactttgatgtgtcaaaatcattgacttggtgctgatagtgtatgttctgcacctactagaatatgagatgcatcctttacggtagtgttaggtacatgtgtgttctggcgactttagtaagagtaggtcttaccggcagcctcacattacttagataatattattggtggcatttttataacttactaactcactcacatttcttagacattactaatgccaatacaatgacaaaaatattttatcttaagagtttacaagttgtgcattttggacagttagacagttatgcattttatttttcttaaacaatctcaattatttttcttggacagataggcagtcatgtaatcatgtttcttttgacatattattttgcttgcttgattcactctagagttgcatgttcagcaagagcaccgatagatcaatgatattttctccatcgcttctaactacttctggtttcttgtattgtaataagggcgaagaatatattctagaggtttcaccaggatcaggaaccaggaatctgata

SEQ ID NO: 740 - protein, 89 aa, Zea mays
MAVMKSSTIVALLLAVAILSSLSPCYEAGGCIGKPKKSPPPPRRPYFSSYSEDHQKDHQNCRLICSSKGFKDGGWCDESVEHKVCCCSH

SEQ ID NO: 741 - DNA, 2580 bp, Zea mays
cggccaggggccagacggtccgcgacctggtgcagggctcgggttccctgtctgacgagacggacggtccgcgccaagaggccggacggtccgcgcgtgcacaggggcggcagagttcgtcggcggcgtctgaatctcgctccggggagggaccccgtcaggagagatcctaggcttcgtctagggtcggcaggccaccctagacacctctaatcaacgtagagccgaagagaagcgaagaatttgggggtagagaaaggctaatctagagctaaactagaactattcctaatgcataagtaaaacgagaaatagacttgatttgatcgattgttgggggttcaatcggccgtagcccttcatctatataaaggggaggtctggatccgctataagttgtttcccgagctaatcccataattttaggtaacaaatcccgcgagaaactcataaccttaactgactctagccgacgtaaattatcgaatttccttgtagtatctgtccctaagaatgaaaatacctttataagatggcaaggaccaacattgttctagaaaagaaaaatcaggaaaagagagggcattgtattgcccacgggaacatgcaaccgaggtaatgatattcatgaggtgtttggttccattgaactaaagtttagtatgtgccacttcgaatgttccaatgataattgtgagtgttaaatatagtttaaatataaaaactaattatacagataagactaaaggcgagacaattttattaaacctaattagtttgtatttaattctcatagttgatataactagataggtaggcacatatatagagagatagatataaatagatataaataagtagatagatagatagatagatagatagatagatagatagagatagatagatagatggactggtagatagattaagagacatggagatagatagacacggatagatgtttagtatataaagcaggcgtggtgatatcaaacacatcaacacatttttggtattagactattgtagctcatatcatctgtcacccatggcgaagtgcagcagcttccaaggattattctggttgctttccatgattcttctagcatcctttgttgctcatgcacgcacaacaagtggtaatcaatgaattattaggcccattttcttttgtggtaaataggtatatcaatttatttagtgttccttaaattaatctgatggagttgcacgtgattgatcttattagggcacaccaaagaggacagcaatgctaggaacatgacgatgaccaagacgagggcatcgggcaacatacttgttagccgtaatgacgacgggccatgctatctagattccggtcttaatgagtacgtctgcagaaagactaataagtgctataagagcttggtgctctgcgtggcgagttgtcaaccatcatcatgaattcatgatactgcggagacatcatgatactgcggagacagacggcgagagatgaggctagctagatgctgtttcaccaaaatattatgtaacacccaaatctcccattttaagaaataaataagattttcgaaaagattatttgaattggagtgctcttacatatcgattaattatgcatttaatatattttcctaaaatgatcaattgggcaaaagaatatatttgtgatgtgcactgcattctggagcatggtttattactgtttgaatttgaattcggatttgaatcatttgaattctcattggatttgaattggaaactaaaaagaaaaaataaaaagaaaaatgcctacgtgtggctccctctctggtgtgtgggccgcttcctcggccggcccacttccacaccggcagctcacgcctaggggtaaaaacggtcgaaaacgatcggtaaacactaaaatcaattttcttttcatattttttctcagaaataagatcgaaaacggtaactccgaaaacgaaaacgacatcggtaatttggaaacatcagaaacgaaagttcggtacgaaaattacaccggttacaatcgaaatcttaaattcgatcggtaaaaactgtaacgtgtaccctcaattgactttaaaaattcacgcaagtcatacattcatatgaaattagtaataacatataaggtaggaggtcacattaaatatataagttgagaagtatataaaccattattatgtatttaagtaaactagaatcaagatgtgtataatgatatgacacttacattctatttgtactactacttggcatagtaaatataattagtgtcctcttggtccttattaagttatcgtgcaaattatgaatatatgtatcaatagtaataacaggtaagaaaatataaataaaatttataaaagtttcaaatgattctaaactatataccattaaatagatcttgattttaggaaaataataaaattagtttcatatttttctaagctaacatgaatttgttatgaatttataaaggatagtacagatttaatatttttctgaacaacaccgaatttattaccgacggtaaaataccgaataaaaacaataattttcgga

SEQ ID NO: 742 - protein, 95 aa, Zea mays
MAKCSSFQGLFWLLSMILLASFVAHARTTSGHTKEDSNARNMTMTKTRASGNILVSRNDDGPCYLDSGLNEYVCRKTNKCYKSLVLCVASCQPSS

SEQ ID NO: 743 - DNA, 5112 bp, Zea mays
gtagcactctgctacaccccccattgtacacctggatcctctccttacgcctataaaaggaaggaccagggccctcttggagagggttggccgcgcggggacgaggacgagacaggcgctcgcctggagccgctcgctccctctcccgcgtggacgcttgtaaccccctactgcaagcgcacccgaccggggcgcgggacgaacatgaaggccgcgggattcccacctctctcacgccggtctccggccgcctcgctctccccccttcgcgctcgccctcgcgctcgacccatctgggctggggcacgcggcgacactcactcgtcggcccagggaccccccggtctcgaaacgtcgacacatttaatgcttaatctaacaataattacttttatatatttgatcgaactttaaaagatttggctcctcagaaagatagacgatgtgcatttattttagaaatgataggatatatttaaggcgacatatggaatagacaggttgggatggagtagatatatatagattcatacgactaaagttgtgttcagcagatcatatatatagctatgcaaaacactattttacactgtagatagcaatatttatgttgtttagagagtgaattttgaaataagaggtgagatagagaatgtgatatggcagctaagagctagttttcaacaagtttgtttctataatagtatagctagatagacagacacgtagctaaaatggtcaactgaccttcgtacaaaaaaaaactttaatccagagatatagcaatatatgcttataactccagacctcagagtcaacccacagatttttgtatattcgtcaaaaagatccacagatttgtggtagagagtatgttttagtagtagtggtatatctcccttgtgggacgacgaagcagccggtcagccggcgctccggccggccggccggcctgcgcctgcacagtacaaatagcaccccccgtcctccagttggctgcatccttctagcttcgatctctatatacctctgtatgtgagtgaggccaatgagagccctcgtagtcgtaagtttcgcttcggcgtgcttgctgctgctgttgcagctcgcaggagcgtcgcatgtcgtctacaactacaaggacctcgaagccgaggctgctgcggcgacggaccaggtgccgccgtccatcgtcaaccccctgctcaggacggggtaccacttccagccccccaagaactggatcaatggtaatgtaaagctactaactaatccaccacccaacgtcgtttgaaggtgatgtgtgtgttaagcatctcctgaaatatataagagagcgaggctagtaatcggcttgttgttcagggttttggtttaccacttgtagcctcaactaataaagctatatatatgagagcgacgagagagaagagacaaaacattcatgagtatggtcagacagactagctagctagacacggcagagaaattacgagagttaaaaaaaatgcgcttgaagggtgaaccaaaacaaaacaactttagtactatgcgtcaacaaagctgtgttcatgtgtcagctagcactagagtcatagtgcgtggccagtgagctgttgtctagcaaccaacgcgaactgaagtttgagagcgtactcgtgttctcgatctcttgcagcgcaaaggtcttcgtacgtgatcaggaatattgcaccatttactgcttaattaattaagtacgtacgtactgtacgtttggctctacctcatcttctaatcttttcggtgctgtcttgtgctctctcggctctgattgcatcgatcggcggcggcgtgaactttgcaacggcggcagatcccaacggtaataagtcgttttccccaccctttttatttcctctaataatgcatcaatattccaactgggtgcatatgcatgcgcgcagcgcccatgtactacaaggggtggtaccatttcttctaccaatacaatcccaagggcgccgtatggggcaacatcgtgtgggcgcactcggtgtcgcgagacctcatcaactgggtggcgctagagccggcgctcagaccaagcatcccgggcgacaggtacggctgctggtccgggtcggcgacggtgctgcccgacggcggcggcccggtgatcatgtacacgggcgtggaccacccggacatcaactaccaggtccagaacgtggcgtacccgaagaacgtgtcggacccgctgctccgggagtgggtgaagccctcgcacaaccccgtcatcgtccccgagggcggcatcaacgcgacgcagttccgcgacccgaccacggcctggcgcggccccggccccgagcagtggcggctgctcgtgggcagcgcggcggggtcgtcgccccgcggcgtggcgtacgtgtaccgcagccgcgacttccggcggtggaggcgggtgcggcggccgctgcactcggcggccacggggatgtgggagtgccccgacttctacccggtgagcaagggcggcgcgccgcgcgcggggctcgagacgtccgtgccgcccggcccaagggtgaagcacgtgctcaagaacagcctcgacctccggcggtacgactactacaccgtgggcacgtaccacccgagggccgagcggtacgtgccggacgaccccgccggcgacgagcaccgcctgcgctacgactacggcaacttctacgcgtccaagacgttctacgacccggccaagcggcgccgcatcctgtggggctgggctaacgagtccgactccgccgccgacgatgtggccaaaggctgggctggaatccaggtgcgtgcgtgcatgcctgcgctagctcggctgttcatccatacgtatatgactgcactgcacggttgtcacgttgactcctttcaacgacgatgatatgacaggcgattccaaggacggtgtggctggaccccagcgggaagcagctgctgcagtggcctatcgaggaggtggaggcgctgagagaaaagtcggtcactctcaagaacaggttaatcaaggcaggacatcacgtcgaggtgaccgggatacaaacggcacaggtacgtacgtacgcgtctactttttttttttttgttcctttgcgtggccacagaactacaccgagcttcctgttcgcctgcatgcaggctgacgtggaggtgagcttcgaggtgtcgccggcggccctggccggtgccgagacgctggacccggcgctggcctacgacgcggagaagctgtgcggcgtgaagcgcgcggacgtgaggggcggcgtggggccgttcgggctgtgggtgctggcctccgccaaccgcaaggagagaaccgccgtgttcttcagggtgttcaagcccgccgccggcagcgacaagcccgtggtgctcatgtgcaccgaccctaccaagtaagtgctagcgctgtagctgagcgcaaaccagcagcaaaagcccgtggtcgtccatgcacactgacttgtgttttttttttgttgctcgcacaactgcaggtcgtccctgaacccgaacctgtaccgcccgacatttgcaggatttgtcgacacggacatctcgaacggcaagatatccctgagaagcctggtacgcgtagcagtacaacaagttttttttttcgtgcaacaactccgccgcgtttacgacgttttcattctcagcgctgtgtcggctcgttacttcttcttcctgctgcagatcgaccggtcggtcgttgagagcttcggagccgggggcaagacctgcatcctctccagggtctacccgtcgctggccatcggcaaggacgctcgcctctacgtgttcaacaacgggagggcgcacgtcaaggtgtcccgtctcaccgcgtgggagatgaagaagccggtcatgaacggggcctgaagatcttgaataaatatatcacccatgcatgacatagtggcgcctgaggaatctttcctttttttaaaaaacatattttagatgtcgtttattaagagttgattgtccatactaaagggcgccccgttatatgttacaatggtaccagctgcacttctagtaacaaagacaaattgactatttgttgttcacttgcaccgttgcacaatatttaaagtacttttcaatttcagatgcctacagaaaaacacaaagttctaataaagtacatctcggactcataaaggatatgtgaaataatattatgactagtgttcgaacaaatggtggagacaactctgacgactttccaattagaataggacatcgaagatcaagtttgagccccttacctttttttctttgataatagataatgtcacaagggacataaaatgagatatcatttggtgtatgccttttgcatacgtgaatgctagttgataaaagtccgtcagaagtaatttggaagctagagttacggtaggatactctagagtccaaagaatttatacttagtagaactaaagctgaatctatgagatgtaacttcgtcactactacatataaggaaggagatgtaagtttggaacgtcaagtagtgtctaaaaagattttttttaaaaaaaaaaataggatcaatgctacaaatagacaaatattatgataaaaatattaaacatagaatcaaagaaggatgaataaagctatccatgaaaataagcatattcaagctatccattcaaaaacaaaagggagacgatgggctttttcgttgtccatttagctctcgcttgcgactagattatccaagcattcgatcctccgaaaatattaattatccagctttatagttttttcaatatccgcagcatatccagatttcttatctggatagaatagttcggatataagatatggatatgggatgaccgatatccatcatatttcggatatctttccgtatattcggatatattttttcgaatggttgtgcgcattttgaagattttttaataaaaaaattaataatacacaaatagtctcaagaattcataacattttatagaggcgtaacatatatccatatattttcctaaaaaatgtttggaccctaaaatccataagatgccatcgtttttccatttcact

SEQ ID NO: 744 - protein, 593 aa, Zea mays
MRALVVVSFASACLLLLLQLAGASHVVYNYKDLEAEAAAATDQVPPSIVNPLLRTGYHFQPPKNWINDPNAPMYYKGWYHFFYQYNPKGAVWGNIVWAHSVSRDLINWVALEPALRPSIPGDRYGCWSGSATVLPDGGGPVIMYTGVDHPDINYQVQNVAYPKNVSDPLLREWVKPSHNPVIVPEGGINATQFRDPTTAWRGPGPEQWRLLVGSAAGSSPRGVAYVYRSRDFRRWRRVRRPLHSAATGMWECPDFYPVSKGGAPRAGLETSVPPGPRVKHVLKNSLDLRRYDYYTVGTYHPRAERYVPDDPAGDEHRLRYDYGNFYASKTFYDPAKRRRILWGWANESDSAADDVAKGWAGIQAIPRTVWLDPSGKQLLQWPIEEVEALREKSVTLKNRLIKAGHHVEVTGIQTAQADVEVSFEVSPAALAGAETLDPALAYDAEKLCGVKRADVRGGVGPFGLWVLASANRKERTAVFFRVFKPAAGSDKPVVLMCTDPTKSSLNPNLYRPTFAGFVDTDISNGKISLRSLIDRSVVESFGAGGKTCILSRVYPSLAIGKDARLYVFNNGRAHVKVSRLTAWEMKKPVMNGA

SEQ ID NO: 745 - DNA, 13562 bp, Zea mays
ctcaaggattttgactttgtgttccacttgcaattaatgttgcttattttaggacatgcaaattctttgtccttatcattgcagaggaaagataaaaacatcttggaggccatgttagaggtgaaattaataaagcagaaattttagcaaattagggatgatggttgggattctttgttgcaggctgtacacaccttttgtgaagaacatggcattcctaagttggatatggatgatgactatattgatcgccataagccaagaaaaagactaaccgcacaaactaccagcattatagatatgattgcttgaacccaattattgacttatagcttacagagtttaatgatcgtttcaatgaggtaaactctcagttgcttactcagattgctgctttcaaccccaagaattcttttgaggctttcaaagttgagagtttggtagagttggctaagtcataccctgatgattttgattcaacacaaatgaaggatcttcatcgtgagcttaacttttttattgataatgtgcgagccgatgaaagattttctagcttgatctctatttctgtgcttgcaaagttgatggtggatgcaacaaaacatatggctttttcctttggtctatcgacttctcaagcttgtattggttcttccaatcgccactgcatcagtggagaggtgcttttcagcaatgaaaattgtgaagacgatgttgagaaatcgtattagagatagatttatgaatgattgtatcatatgcttcgtggaatcaggatttctagccacaattccaattgatgatgtgatagttcgcttccataagatggaggaccgtaaccgtactaccgtagagaaaaaatataaaaggtatacaattattttgtaaaatcttattttgtcataatatggtgcttattattttataaattattgatgttgtgtatggtattatatttctcaagctataagttagtgttagtatggatccggtaaaaattatcctggcttcgcccctcgatctggaggctggtggccgctggcgcagcgtacgcaaggcagcatccgacggcgagctcgtcgcgaggttctacttcacctacggcgggcgcagcgtggtgatcgggccaccgcgtgcgtgctgtgtgcgccggagtttctggacatggcggcggcggcacaccatcgtggacgccgtgaagtgcaagcgcctgcttccgctcgcgggctccaccgacgaggtcgacagctggggcatcgccgtcgaggacagcgcgagcgtggagtcgttgagcacgaggtggacggggcatgccgagctgctccgcggcaccgtgcgctccaatagccgaccacgctttcgagctcttcaaggattgatcatccgcaacctgcctcagcaatcggagtgttgaggtgctcgcgaccgccgcgcgcgtgcatgccatccacgaggcgtagtagcccctgacgctgcaggtttgtctgtgactcacacacgcacgccatatgtttgttctaatgctctagtgcagcagtgttgcgaatgcctaactgcaaaagcaccaagtcaatcagcgtgggatcacctgaatttaatgttctttttagccatcatatgcaccatgatgttgtgcttgccattaagatcggggaacgtatccggtgttcaaaggggtacggtggtcacgtgtacattttaaatttggaacgtcgatccaacatctaacagaagcaccaattttacaaagaacccctttcaccttcctcacttggtgggacggttcttaatcaaattaactgcagccgctggtatacatgtacatgtgggcccgcctagcccggcacggcacaggcccacaaaaacacggtccacaaaagcacgacccacaaaagcacatatctaattatgggccgtgccgtgccagcacgtgtgcccagtcatcggcccacaattagttatgtgtgccaggccgacccaaatagcccaaaataccttaatatgccagaccggctcatatacatacaacagtaatacatcaacaaaacgtataaaatatatatatgaccaaaataaaactaagatgttttgtggatgcacattataaacctttggtcagaaagaaaaaaatattacaactagctcacaaaaaatatccagttctctgtttagtgtttaattgagtactatacatccatacagaataaatatacaatgatcatcatcactattcactatccatatctaggtattggttctcgatggcttattaaagctctagattctccaagttatgctagtcatgtgggctttgacagaccttagttaaatactgagtctatattttgtgggccttagttaaatgggtcgtggcaggccggcccgtgggcttgacttgaggcccaggcacggcccacaatgtgggccgtgccggcccatgcccacaattaggttgggcagtgccagatatgggccgtgccagaaattgtgtgctttgggccggcctattaggcacaacataaatgtacacctatagccgcatagccgctggatgtgagatgaatgtctcagatttaaaatgtgcacttgagcaccgtacctctttgaacaacagatatgttcctttaagattgatggtggaaaaaaattagtcagtacctcactgtatggcggcattgtttgattatttcagttcgcacccgttggaccttgctcattaaaaaagtttataccatggagtctttgcatgtagttgtgtagtaggggaagagtggcataggaggaatcacaacttcagctagcttctctagccttagggtatttttgtctttttgcagttcggtcttttcgcagccctgcgctgccccccctgtccgcctgtccctagacctgttttgcgtcggcggggaagacagttgacaggaaggacacgatcttcgtgtccgatgccgatcttcatgcgagcagcgagccactacgttgcgctgccagtgtcggctatggtatccaggcattcgttgtgcacgttgacgatgagctcgaagccggtccgggtgaacgcgagcagcacggtgaggtcaacgtcgtacatccgcacgtcgatgctgaggccagccagcagcggcatgacagattgcggcgtcaggagattgtgccagtaggtggcggggctgggggcagaccggcaggcgaggcctatgggcgggcagtgctgtgagttagagcagtgtggcaatgttggtggtagtggtgacacccttcgggagcggaaggaggctggaacttcaggtcagttctattgccataaataaataaaataaaataaatgaggctcaaaattccaaaatgtcatttcagcgtgtgcaccgcttcataaggccagtctcgtgaatcctacaagtttgatggtattctgggcctcgggcatagcccatttatcataaataaggacaattttgtaattctctccttttctttttgtttgcttgtatttgtatttcacatgggactcacttatgttgatgtattttagcttgtaaaaaagagtaaaaacattattcagtgaagtgacgcattgagttcatgattaagtttcaattatcctttttaataggtccatgccacgcttgtataaggattgagtaaaaaaactaactttattacaccacagtagataacaataagtcatatcagttgcatcacacaagcacactatttacttcttgtttttggatcaattctttggtgtctgtaaacccatacaacataacttgaatatgaacagcactgcagggataattgaaacctaggagtaaataaaatggatgtgaacgtttcagattatttggcattctgtaaaagacccaacacccaaatgcttgaaaaaatatatcatgttgtaaaaattcgatctgcatttccttctgtaagcaataaaacatggctcttttaagaattaccttgacaaaaaggtaaaatataatatcaataataactccggataggaaaaacttattcttctgcttataattatatcttaaatttaagtctatgacaatgtgaaatatttattgctagtgctacattttaatgtgtaatgaaagcactttcttttggacattcgaattctcctttgaaaatgatatactcctgtgattctggtttttaggagaattgcatgcatggcctagtggtagcgttgagataatgagttaagctttttgaagtttctaatgtgaattgtttttcttttaacttaaatactcattcagcgaaagatcctctagcgtaatgggtaaggattccgagtatcaccttcaggttctgggttcgaccctcatcgggggcgaatttcgggcttggttaaaaaaaatactctcactatgccccgcccgctcccgggttacgttctgtgcgccaccctctggctgagctgttgtaaagtgggcgatgacggcccgctagtgatggggggcaggggtggacccaagtacggctgagtgagggcacatgcccccgcccatttctttgttctaagtactagggtctaaattttcaccgtgagcccccctgcttagtctaatttagatgcccttgctctggtattttgatgctcgtccttacaagtatgcccttagtcatattttgtcctgggtccgcccttgatgagaggggccagggtttagagattttctcggccgggaccaatgttccggtctcttcttaatatagtaccgggacagtctttccctctccggccgagttttttatactcactctaggtgcaaacgtaagttgttcaggcttgtgcttaaggattaagaaagtaaataaaatgaccatgttacactttttttatttataccgtatcgggaaagataaaccatttatctgtgagtggtagcatggtcaaggagaaaaaaatagatgcatagaggttctgggacgactcacatttagagcatagttgaaaaggctaaaacaaccaggagggggtggggtcgggatacataaattttcatgagtgatggttgaactattgagggtgcaaaataattttttcaacaaataatgtggtgaaatacctaagaggggtgcacctagcatagattttttggggctccccttggcctctcctttcttccgccctgaaaacaacctacatggatacatctgcaaccagagggagtatctgatgctttttcctgggcagggagagctatgaggcgtatgtcctcaaagccactttgcattgtgtgaaaccaatatcgatctttgttacttcatcatgcgtgaacatttgtggaaactactagcttacaagcattagtgacagctcagaaaaaagttatctctgaaaggtttcatgtgtaccgtgggaaatgagaaatgttgccaactcaaacaccttcaatatgttgtttgcaggcaaactcttctggaagaaaggtgtctaaaactatgaacgggttacagaaaggtataaaccacggctgtgcattttggaagtatcatctatagatgtctgttgaggggaaagccgtacgccaacgttatttactcagaaacagcttcaacacacagttgtctgctttatgatggcatctccacccaggcacccaccatcacctatctctcgtgcctgtttattttcttgccctttctgatcataaaaaatcattaagagtttgcaaacatgcataggcatatcaatatgctcatttattaatttgctagcagatcatcttcctactctttactttatttattgtttgaaaaatatgtcctgcacctagggagctcgtatacagtaccaatgcatcttcattaaatgtgaatttcagaaaggaagtaggaacctatgagagtatttttcaaaattaattagcggcttctattatgtttatagcaaaggccaagggcaaaattggaacactaatgatggttggttgcatgagtctgtcgattacttgcaagaaatgtgaacctttgtttctgtgcgtgggcataaaacaaacagcttctagcctcttttacggtacttgcacttgcaagaaatgtgaactccttttcatttctgtatgtggacataatgccaaagcatccaggctttttcatggttgttgatgtctttacacagttcatctccaccagtatgccctctcatactctatataaacacatcaacagcatcgcaattagccacaagatcacttcgggaggcaagtgcgatttcgatctcgcagccaccttttttttgttctgttgtaagtatactttcccttaccatctttatctgttagtttaatttgtaattgggaagtattagtggaaagaggatgagatgctatcatctatgtactctgcaaatgcatctgacgttatatgggctgcttcatataatttgaattgctccattcttgccgacaatatattgcaaggtatatgcctagttccatcaaaagttctgttttttcattctaaaagcattttagtggcacgcattttttgtccatgagggaaaggaaatctgttttggttactttgcttgaggtgcattcttcatatgtccagttttatggaagtaataaacttcagtttggtcataagatgtcatattaaagggcaaacatatattcaatgttcaattcatcgtaaatgttccctttttgtaaaagattgcatactcatttatttgagttgcaggtgtatctagtagttggaggagatatgcagtttgcacttgcattggacacgaactcaggtcctcaccagataagatcttgtgagggtgatgggattgacaggttggaaaaattaagtattgggggcagaaagcaggagaaagctttgagaaataggtgctttggtggtagagttgctgcaactacacaatgtattcttacctcagatgcttgtcctgaaactcttgtaagtatccacctcaattattactcttacatgttggtttactttacgtttgtcttttcaagggaaatttactgtattttttgggttttgtgggagttctatacttctgttggactggttattgtaaagatttgttcaaatagggtcatctaataattgtttgaaatctgggaactgtggtttcactgcgttcaggaaaaagtgaattcttggttactgcatgaataacttatggaaatagaccttagagttgctgcatgattatcacaaatcattgctacgatatcttataatagttctttcgacctcgcattacatatataactgcaactcgtagttgcgttcaaaaaaaaatgcaactcttagaacgctcaccagtgtaatctttcctgaattgttatttaatggcatgtatgcactacttgtatacttatctaggattaagtaatctaactctaggccccatatttgcagcattctcaaacacagtcctctaggaaaaattatgctgatgcaaaccgtgtatctgctatcattttgggcggaggcactggatctcagctctttcctctgacaagcacaagagctacgcctgctgtaagggataacactgaacatccaacgttgattactctattatagtattatacagactgtacttttcgaatttatcttagttttctacaatatttagtggattcttctcattttcaagatacacaattgatccataatcgaagtggtatgtaagacagtgagttaaaagattatattttttgggagacttccagtcaaattttcttagaagtttttttggtccagatgttcataaagtcgccgctttcatactttttttaattttttaattggtgcactattaggtacctgttggaggatgttacaggcttattgatatccctatgagtaactgcttcaacagtggtataaataagatatttgtgatgagtcagttcaattctacttcgcttaaccgccatattcatcgtacataccttgaaggcgggatcaactttgctgatggatctgtacaggtgatttacctcatcttgttgatgtgtaatactgtaattaggagtagatttgtgtggagagaataataaacagatgccgagattcttctctaaaagtctagatccaaaggcattgtggttcaaaacactatggacttctaccatttatgtcattactttgccttaatgttccattgaatggggcaaattattgattctacaagtgtttaattaaaaactaattgttcatcctgcaggtattagcggctacacaaatgcctgaagagccagctggatggttccagggtacagcagactctatcagaaaatttatctgggtactcgaggtagttgatattttctcgtttatgaatgtccattcactcattcctgtagcattgtttctttgtaattttgagttctcctgtatttctttaggattattacagtcacaaatccattgacaacattgtaatcttgagtggcgatcagctttatcggatgaattacatggaacttgtgcaggtatggtgttctcttgttcctcatgtttcacgtaatgtcctgattttggattaaccaactacttttggcatgcattatttccagaaacatgtcgaggacgatgctgatatcactatatcatgtgctcctgttgatgagaggtaatcagttgtttatatcatcctaatatgaatatgtcatcttgttatccaacacaggatgcatatggtctaatctgctttcctttttttcccttcggaagccgagcttctaaaaatgggctagtgaagattgatcatactggacgtgtacttcaattctttgaaaaaccaaagggtgctgatttgaattctatggttagaaattccttgtgtaatccaattcttttgttttcctttctttcttgagatgaacccctcttttagttatttccatggataacctgtacttgacttattcagaaatgattttctattttgctgtagaatctgacactaaagctaatagctactgatgttgcagagagttgagaccaacttcctgagctatgctatagatgatgcacagaaatatccataccttgcatcaatgggcatttatgtcttcaagaaagatgcacttttagaccttctcaagtaatcactttcctgtgacttttttctatccaactcctagtttaccttctaacagtgtcaattcttaggtcaaaatatattcaattacatgactttggatctgaaatcctcccaagagctgtactagatcatagtgtgcaggtaagtctgatctgtctggagtatgtgttctgtaaactgtaaattcttcatgtcaaaaagttgtttttgtttccagtttccactagtttttatttaccaatgcacgatttatgtattttcgcttccatgcatcatacatactaacaatacattttacgtattgtgttaggcatgcatttttacgggctattgggaggatgttggaacaatcaaatcattctttgatgcaaacttggccctcactgagcaggtactctgtcatgtattctgtactgcatatatattacctggaattcaatgcatagaatgtgttagaccatcttagttccatcctgttttcttcaattagcttatcatttaatagttgttgactagaatctaaacacaaatttacctaatatgtttctctcttcagccttccaagtttgatttttatgatccaaaaacacctttcttcactgcaccccgatgcttgcctccgacgcaattggacaagtgcaaggtatatgtcttaccgagcacaattgttacctgagcaagattttgtgtacttgacttgttctcctccacagatgaaagatgcatttatctcagatggttgcttactgagagaatgcaacatcgagcattctgtgattggagtctgctcacgtgtcagctctggatgtgaactcaaggtacatactctgccaatgtatatgctgatgttttatacattctcttgcataatttgattcgagtcaccacaattagtgtaactgcaatctactcttgagtataccatttcaacaccaggcatcaccaaatcacacagaacaatagcaacgaagccttttagttccaagaaatttagggtagcctagagttgaaatctaacaaaacaaaagtcaaagctctatcacgtggatagttgttttccatgcactcttatttaagctaaatttttgggtatactacatccatttaattattgttttattgcttcttccctttgcctttcccccattactatcgcgtcttaagatcatactacgcactagtgtctttagaggtctctggtggacatgttcaaaccatctcaatcgaatcggtgttggacaagtttttcttgaatttgtgctacacctaacctatcacgtatatcatcgtttcaaacttgatccttcttgtatcatcataaatccaatgcaacatacgcatttctgcaacatttatctgttgaacatgtcatctttttgtaggttaacattatgcaccatacaatgtagcatgtctaatcatcatcctataaaatttacattttagcttatgtggtatcctcttgccacttagaacatcatatgtttgatgccatttcatccaccctgctttgattctatggctaacatcttcattaatatcctcgcctctctgtatcattggtcctaaatatggaaatacattctttctgggcactacttgaccttccaaactaacgtctcctttgatcctttcttgtgtgtagtagtaccgaagtcacatctcatatattcggttttagttctactaagtcccgggttcgatccccctcaggggtaaatttcgggcttggtaaaaaaaatcccctcgctgtgtcccgcccgctctcggggatcgatatcctgcgcgccaccctccggctgggcattgcagagtgggcagttgatcggctcgttagtgatggggagcggggttcaagggttttctcggccgggaccatgtttcggtctcttaatataataccgggagggcagtctttccctccccggtcgagttttagttctaccgagtctaaaacctttggactctagagtcccctgtcacaactcacaactctagttttctatttacttctacctagcgtttattaatgatcactatatcgtctgtaaaaagcatacaccaaggtaatccccttgtatgtcccttgtaatattatccatcacaagaaaaaaaaggtaaggctcaaagttgacttttgatataatcctattctaatcgagaagtcatctgtatcttcgtctcttgttcgaacactagtcacaattttttttgtacatgttcttaatgagtccaacgtaatattccttgatattttgtaagccctcatcaagtcaatgaaaatcacgtgtaggtccttcatttgttccttatactgctccatcacttgtctcattaagaaaatatctctcatagttaaccttttggcatgaaacaaaatcacacagaagttgtttcctttttttaagatcccacacaaaagaggtttgatctaaggaatctggatccctgacaggtttatcaaaatcctttgtgtttttcttaaaactgaatattcctccagcttctagtattgatgtaatattcaatctgtttagcaagtgaacaccttggttcttgttgttactgtacatcccacccacccccccgaggcccagattaccacgacatgaatacaagaatattgaacccagatctagagtttgtttgtactgttgaaaatcggtgacaattcattttgttattgcgctttctgataacgacaggactccgtgatgatgggagcggacacctatgaaactgaagaagaagcttcaaagctactgttagctgggaaggtcccagttggaataggaaggaacacaaagataaggtgagtatggatgtggaaccaccggttagttcccaaaaatatcactcactgatacctgatggtatcctctgattattttcaggaactgtatcattgacatgaatgctaggattgggaagaacgtggtgatcacaaacagtaaggtgagcgagcgcacctacatgggtgcagaatcttgtgtgctcatctatcctaattcggtaattcctatccagcgctagtcttgtgaccatggggcatgggttcgactctgtgacagggcatccaagaggctgatcacccggaagaagggtactacataaggtctggaatcgtggtgatcttgaagaatgcaaccatcaacgatgggtctgtcatatagatcggctgcgtttgcgtctacaaaacaagaacctacaatggtattgcatcgatggatcgtgtaaccttggtatggtaagagccgcttgacaggaagtcgagcgttcgggcgcaagatgcgttgtctggcatgctgttccttgaccatttgtgctgctagtatgtactgttataagctgccctagaagttgcagcaaacctttttatgaacctttgtatttccattacctgctttggatcaactatatctgtcatcctatatattactaaatttttacgtgtttttctaattcggtgctgcttttgggatctggcttcgatgaccgctcgacccttggccattggttcagctctgttccttagagcaactccaaggagtcctaaattttgtatcagatacgaaggacttcagccgtgtatgtcgtcctcaccaaacgctctttttgcatagtgcagggggtgtagacttgtagcccttgtttaaagagaaatttgaatatcaattataagtattaaatatatatttaattaggtttaacaaatttggctcgtttttagtctttatttatgtaattagttttaaaaatagactatatttaatacgaaattatcatttaaacatttgatatgacagagactagattttagctgagtgaaacaataatcactttggtatggataaatgttcccgtggttatccacttgaaaaaccgagggtgttgttgtctctgtcgtcttgtcgggacatgaacacgcgagtttccatgcaggaacctggaatctcatcccatgtagtgcaactaggaatcccattccatgtagtacaaacagaacctagaatccaatgggtcgtctctgagtgagggaacgtccaagtgagtatccatgtacggataagggaggctatatatttaggccctgtttcaatctcacaggataaattttagcttcctgctaaacttcagccatataaattgaagtgctaaagtttagctccttatggtatttggactactctaataaagtttagtacattggaataaaaagacacatatgcccttaatgcggagagagggaatgatgttggagggtatggatgaaaaatgggttcctggcccacgtttagctacttttagcatctcttgagcagtttatgagataatatgtgctaaattttatcacaccatcattagctcttttgtttagatcactaaatggctaaaagtagctaaaaaagttgctaaagtttatctagtgggattgaaacagggccttaataaagatggtgtt

SEQ ID NO: 746 - protein, 516 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 747 - DNA, 3935 bp, Zea mays
acacggcatctctttctcaaaggtcgaaccatgtgtgttccatgcatgcgtggaacatgcaaggttgtcacgtatagggaatgatgacacacgagagcgcctacaaggcaacaaacaccttacgtaccacgtagaatgcattttgctaccacctgccaccggatgacatgtatgcatgcatgcgttgtgtacgcatacactgctgtctgctggtgcccaaagaccatctagaacagcatcttttaattctccatttccctcacgccattgctagtgccttgcacatgctcgcactccctaacacatcttcctccctttatttttcgttgccaattgcttgttgttcaaatgccacgttttccttacacagctgtagggcaccgtaccacgtagaatgcattcctcgccaccaacaaacaacacggccgggcatatgtacgtcttacgccggaccatcaccagtatatatgatgctagggatcagtgggcgccctttttgcctcgtcctcccggggcggcattcctatgtcctaactgaagcaacccacgcgccgccatttctgttgcgaatgagtccatggacatatgtgccaacagaacccctcggaaggcaccatctatctatctatctctcaagcaatattatatttggcacctacgctcaagtacatagacagtgtgcacggcattgtgcagctggaaagcccgcccgacacgagggctgccaaatcgacagctccgcgcccttggaaatcctagtcacttgttcacaattgaccaatctacccttgaagcacacggtggatggtactgccacatttggcttataggggcatagaggacaatgaatgcaactggagcgggaaggagagctttaatttgtaagtactcggtgaacacggcacctgatgatgatgatgatggacagcgaggaattgttataaaaggcgcccgtccctcccatggctcaagaacaagggaatcgaagccattccctcttcaagaggggatcatcagattgggcttattattccttattactccaggtaattcttagtttgttgcccttccaaacctttacatctcatataagaatgattattacatgcaagattatgttgacatgcgtcgtcatggtattttttttaggcaaggatcggagttgctctgaattgactgaaccatggcggcgacaatggcagtgacgacgatggtgacgaggagcaaggagagctggtcgtcattgcaggtcccggcggtggcattcccttggaagccacgaggtggcaagaccggcggcctcgagttccctcgccgggcgatgttcgccagcgtcggcctcaacgtgtgcccgggcgtcccagcggggcgcgacccgcgggagcccgatcccaaggtcgtccgggcggccgacaactgcgacatcgcgcgccagcttggcgccgccgttcccgggcagcaggccgcctgggaggcggaggaagaggcagcgaagaggaggaagcagaagggcggcggcagcaagaagcagcagcagctgggcgatctgagcctgaggaaggtcagggtcaagatcgccaacccgcacctgcggcgcctggttagcggcgccatcgccggcgccgtgtccaggacgtttgtggcgccgctggagacgatccggacgcacttgatggtcggcagcatcggcgtcgactccatggccggggtgttccagtggatcatgcagaacgaagggtggaccggcctgttccgcggcaacgccgtcaacgtcctgcgcgtcgctccgagcaaggctatcgaggtacaacccacccatgttctcagaatgttctagaagccatggtggtcgtgctgtgcatcgtcagtgagtactatgccttcctctcatgttttgtttacatggcggtggtggtgcacagcatttcacctatgacacggccaagaagttcctaacccccaagggcgacgagccgcccaagatcccgatccccactccgctggttgccggagctctagccggattcgcctcaaccttgtgcacctaccccatggagctgatcaagaccagggtcaccatcgaggtgagcgacaacaaacacaacagttcgcgaagtttttcaacggtctcactactgacaacacatacatgcatgcatgcgtgcccgcattgcattgtgtgttgtgtgatggcatggcatgcagaaggacgtatacgacaacgtcgcgcacgcgttcgtgaagatcctacgcgacgagggcccgtcggagctgtaccgtgggctgacacccagcctgatcggcgtggtgccgtacgcggcctgtaacttctacgcctacgagacgctgaagcggctctaccgtcgcgcgaccgggcggcgtcccggcgcggacgtgggccccgtggcgacgctgctcatcgggtccgcggcgggcgccatcgccagctcggccacgttcccgctagaggtggcccgcaagcagatgcaggtgggcgctgtgggcgggaggcaggtgtaccagaacgtcctccacgctatctactgcatcctcaagaaggagggcgccggcggcctgtaccgaggtctcggccctagctgcatcaagctcatgcccgccgccggcatcgccttcatgtgctacgaggcgtgcaagaagatcctcgtcgacaaggaggatgaggaggaggaggacgaagccggcggcggagaggatgacaagaaaaaggttgaatgatcaaagttcttggccaagaaggtagcaatgtcgtgaagcgtacgtgaactggaaacggatggacaagtatatttggagtttgatgtggtgtttccggatcgtgtgtttgtctcagatgaaaaaaatacaatattttgagtccaagttaatcaatgttccatttgcctatccggagctcaatttgttaggttgcatgttccatgtaattactatatttgcctatttcaattttcaagctcttttcgttgtgtttagtaaactgtggtgtgaccacttacggtcacaataaccatttttatctgtttttggtataataagcatgtctgtgttcggtcctatactcctatttgggacagctagcgggtggggaccaggtatggattcggatcgaatacgaatgaaaacgaatccgaatgtcactatttaccatattttaattcgaatacaaatacagatactatcggatacgaatacaaaacgaatagttcgaattcggattcatattcggatacttacttgatttggaacatagcatcatagcatatatgaatttattttatcgatggatttatagttgataaaaatcatattacaagcaaattataaacaatagtacatatacattatttaattgaaacttagttgaatatcatattttaaataaattatttatacctagtatatttatattttagtctctaaatataatcttttcgtatattaagtaaatttgtattttggactctaaaaactcgaataatctaatgtattcaaaattatactttttaaatattaattaaaatgtatcattgtatatcactagtaatgtaagattaacacaatcatttatttatgatatgaatattttttaacattttaaatggtgtatatcagttttagtacatttttaaagtttaaaatcgcttgtaattagtaattagtaataaaagtaagtttaaattggttttatcgaatactttttccttttggatacgaatagtatcaaatatttcacagtttttgtcgaatgttgtcgaatacaaatcttaaactggatagagaaaaaacgaattcgggtatgtctatttaacatccatattaaaatcgaatacgaatacggatatccatattagcactttatccgaatacgaataattcgggtctctagacatccgaatccacccctagtggggacgata

SEQ ID NO: 748 - protein, 437 aa, Zea mays
MAATMAVTTMVTRSKESWSSLQVPAVAFPWKPRGGKTGGLEFPRRAMFASVGLNVCPGVPAGRDPREPDPKVVRAADNCDIARQLGAAVPGQQAAWEAEEEAAKRRKQKGGGSKKQQQLGDLSLRKVRVKIANPHLRRLVSGAIAGAVSRTFVAPLETIRTHLMVGSIGVDSMAGVFQWIMQNEGWTGLFRGNAVNVLRVAPSKAIEHFTYDTAKKFLTPKGDEPPKIPIPTPLVAGALAGFASTLCTYPMELIKTRVTIEKDVYDNVAHAFVKILRDEGPSELYRGLTPSLIGVVPYAACNFYAYETLKRLYRRATGRRPGADVGPVATLLIGSAAGAIASSATFPLEVARKQMQVGAVGGRQVYQNVLHAIYCILKKEGAGGLYRGLGPSCIKLMPAAGIAFMCYEACKKILVDKEDEEEEDEAGGGEDDKKKVE

SEQ ID NO: 749 - DNA, 2566 bp, Zea mays
gtgtccagtggctgcagggcagcccctggcgctgttgccctcttcggtggcatgacgaaggcgaacgcttgccaaaggttgtggaagtgagttcaccggaggtgggcgctaatgttggtcacttgttcttaaatgttgtgaattaagaacaaggcaacacaattgttaaaggtataaaaaccttcatcctccgaagcattgcttcctctaggattcaatgatcattggacgaaggtcttgaaggacatgccttcaacatgttatcaataaataaggatacacaaggatagatacaatgattataaatcataagtctattcatatcagcattccataaagtttatatgaacatgaatatttattacattgataccttcgacttgctcgaaggtgttgacacgaaagcaagattacaattcagcgtgaacagtacggtgctactgttcatctatttataggcacggggcgcagcctgggtaaaattacatttatgtccctgacatttacttataaccataacatggatcattaaggactaagcagtctttttccctttcggcttgcatcatctttagtcttcatcactattataagccgaagctattaccccttggctatagcttcggtgttcatctttattatcttcggactatgtcttcaccttgtatacctttgtcttgggggaaaaccttcatcctgaagccgaagctccctgtaataattcatatcatgctaaaaataaatggtcagtcctgtttttgaggaccttcggaagaggaaggccccccaacaagacgattaactagtattgtctcactgcattgtttttttggcacttcatcaataatgcctcaatagcatacttcattttaggaactttattaaaactgtcttaaaatagggccaagtcataaattcacttcaaagtgactcttcatttcttacttcctatctttggtggttttgtatatatatatgttcatggttgagtgatgttcctacaccactacaccacaccttagatatatatacagaaaatagcttcactatctagattccatggcatcaaggatgggaatggtggctattgtgtcactatttgtttgtgctcttgctgcttcaacatcagttaatgctaatgtgtggcagactgatgatataccagttgttaatagcaacatggtgaggcatagcaacatggagaggcaacaacaacaaggtggatttattggccatcgtccaagacttgcatcttttaatagggcatcaaatcaagatggtgatcgaaaaagaactgtgcctagtgggccagaccacatgcatcacagcatcccatcgcatacccctcagcatccaccagtgtatgtccaagctctttatgaagatgatagaagtagaacatcttctggtccatccaaatcgataggccctccaccattatcggatagatactagttcatgcaaaggtatagagtgtttatgcacctacgccaatgaataatctctaactacccacatgtactggcatggtgtttggtaaacatgaagcaataatttcctcttatcgaaatacaggtctcgagctgcatatgaaaaaagataattatgaagcagcaaatcttttcggttgaaaaagtacatctctattattaatggtaacctatatatcaatctacaatgtgtgtgtgtgcatctcgatgcatacattcatcattttatgtttgcaaggtactttaatggcgggaaggattagattattcttgtttcctcttattcttacctttttttcaaaattaccagtttccaatgtctgaatatgcaatgcattataaaccctagtcagcatacatcgagtcaatatataattctatatgttcaagaattgttgctgggtatggcaatgcgacgtgtttttaagctattgggtcgaggattttagtacaggtaaattacatttctcaatcttcaagttgtattttccaactttaaattatggaaccgggtaatgctccactccaatggttgaaagggaaaaaatttggtccccggactaatttcataggtggttctctattttttaaaacaacaaaaatagatttgttctttaaaattgataattaattactcataaattagaaaaaaatatgaaactagttatagttttcttctaaaattattgtatgtttgttggtgctctaggtatagagtttgaactacagctagaggagtaaaatggtgatttaaacaaggtggcgcgaactcaaaactctagcagtaagaaaactttggaccaacaacttgacataatgaagcagtcatgaattcaacaactcaaaaactaagtagcaaagcaaaggctcaaaatgtttttaggtgattttcatatctaaatttatctttgggcaaaagtggactgtaggtaaataaattagaaaggagaagaaaatatcacacagagcaacctgaaatttgataccacttgataagactcaatgggtagaagggagcctgatctttcaatgagaaatggtggacgtcgaaaatttgttggaggccaatgttggtg

SEQ ID NO: 750 - protein, 131 aa, Zea mays
MASRMGMVAIVSLFVCALAASTSVNANVWQTDDIPVVNSNMVRHSNMERQQQQGGFIGHRPRLASFNRASNQDGDRKRTVPSGPDHMHHSIPSHTPQHPPVYVQALYEDDRSRTSSGPSKSIGPPPLSDRY

SEQ ID NO: 751 - DNA, 6473 bp, Zea mays
ccctttcaagaggaacatatatatatgggtacgttaaatgctagtcacagtttatgagatctggttggtctctagatacccatgaaaggctatggagtttgacttatatgcttcaactagaggggatgcgctcggcagtacgatcgacgttacagtaaataaagattgatgatgagtagcacagtcgacagtacgatcaatagttgatgtggcgatcgacaagacactggttcactggaaccagcataagatagttgataacctttctaagtcagcaggtcgtgcatatggtcgtataaacactatttgcactgtaaatagcaacgtgataggggatgaaataggagagttgatggagataacatacgagggcaagatgattgagcatcctaaatttcatgttttttattgccagacacttgctcatcatcggacttgtaatgccatgtatgtgctagaaaacagcgattagtaacaagatctccatctctgtaacatgtatgtgatgcaaagaaggtttaacttaacataacacaatcacactcctttcgttaaattttttttgaaagaaagagattggaggggattttagccctcaatcccctcccttccaaacaatggctaaataacacaatcacaaaaccacgagagaaggcatgaaggaaaccacaagcgcgccaggcatgaaggaaaccacaagcgcgccaaaaccacccccaggcggcagcgcccgtaggcaccaacccacccacagagaaggcatgaaggaaaccacaagcgcgccagcgcagcagtcggggagaagtggaagtggactcgaggatcactctcgctatcgactacgctatctcaactgccacggacaatcgaaaccaacagtgaatcagccggcgccgcagcatgcctgtacctctcggctctcgctcttatccccacccacctcgctttctcccctctacaagaaagcgaccaccgctgtgaatcagcagagctgcagtgagagcaagtgagaggatcagaggaggcatccgtgaccaaagatcgagtagccaagaagaagagagatgaacgccgacttcggcgcgcccaaggagctcgcgggaggcctgcagcagcggcgggccctgtaccagccccgcctcccgccatgcctccaggtgattcccatttggtcgagcgatcacccgcctttcatctgtgcgattcctgtccgcctgctcatctgacatctctcccccgtctctgctgggcgtgattctgatccctcatgattttttggtggtggtgattgggaggggttattgggggtttacccttcttgattcctctatctatcgacggccaaacaatcggttttgacttttgacccaattccttccttctcctccagggaccgacggtaagggcggagtacggtgacgcgaccacaaccatcgatcccacctgtgcccaagccgtcgcgcaggccttcccgcacacctttggccagccgctcgtcagcttcgtcgcgccggccgccggcgccggcgccgttgaggagcgccacccgatcaggcccgcctcatgacgccctgtctaatcatgtgcgtgcgagatcgcgcgaggcttgcctgaatttgcttccttgcagggtgggcgtggtgttctctgggaggcagtcgccgggagggcacaacgtcgtctggggcctccatgacgcacttaaagcctacaatcctcagagcttgctctacggattcgtcggtaaccaaaatctcgcaaattacctattcggtcacatttttggctatttatacaaagtaccttttcctccagtatcttttttaagatttgtgtgcttcgtgttataggtggcacggagggactgtttgcaaacaagacgttggagatcacagacgatgttcttgcttcctataagaaccaaggttggcttcacttgttctcccctaactaattgtggccaggtttctgttattctcaatactgggatattttgtttgctcttttcaaggtggtttcgatttgctcggtaggagtatcgatcagatccgcactactaagcaagtgaatgctgcaatgacaacatgccacagtctgaacttggatgggttggtcatcattggaggtactaattaaggacacccaatgcccacaaaaggctaccaaaatccgtccaccttttgttttgacataatttgcatggacatgccacaagtcactaccggaatccggctctttgccgagtgccgatgggtttgcggagtgtttttttcgggcactcggcaaagaaatcaataattttcactagtgatgatttttatctcctctgtcctaaatataattctttctagccttttttctgtccacattcgaatgaataataatgaatgcagacatacaaacaacattcatagatcaattaatgaatgtatgtttaatctaaaacaaattatattttgcgacagagagagtattttataaacaaatttaccatgcagttggtgaccatccaaccagtttaaattttgttatgttctaacatgtgaaaactcaatacatgtttatcattagaattacctggatttttctagtggttcaaactagcatttaaaaaaacatcgttctcacttggtctacaggtgtgacctccaattcagatgctgcacagcttgcggagacccttattcagaataactgtaagaccaaggtataaccattattagtctaaactgtttttaaatgctcatattcttggagcacatataagactcctaagaatccaaaaccttcattaaacaggttgttggtgtgccagtttcattgaatggtgacctcaagaaccagtttgttgaaacaacagttggatttgatacagtatgtaaggtaaagcgcagtctagtagaaattttgcataatgtgtagatcctgatggaactgtaatcaaatatgacataccattgccaatctgtcactaatgtcattttgtgtggtaactacttttcaggttaattcacagcttgtaagcaatgtttgtcttgatgcgatctcagctggaaaggtaattatcttgtcacccatttggattagtaactaagcaggctgcaaccattattactactaagaaccatggctgatgtttttttcttcctatcagtactattattttgttcgtctgatgggacgaaaagcatctcatgttgcctttgaatgtgcacttcagtcacacccaaacatggtatgattttatcaaatctgtggttataactctctactatatgaaatgaagaaagagcatcagcatccttttttttcaatttctctttgcagctcatcttaggcgaggaggtagcattgtcaaaactcacactgatggaaattataagcaagatatgtgatggagtacaagcaagggcagaattaggtttgtacagttctttgattgttatgttgcagcagttagtaggaaaaaaagtttgtacctttggttgaggtaaattttctaaaaaaattttctagtcaatcaaggtatcgggatattttataaatcatacactaaaagactggttatccatcttcagggaaatatcatggtgtgcttgttattcccgaaggacttatagaaagcattccagaaatgtatgctcttattcaggtatgtgtgatctatcttcatggaaacaacgggatgataaatagcattatttcagttccatcttcttgttttctgttcaaatattccaggaaatcaatatccttcacaacagtaatgttcctgtggctgagatgtcatcacaactgtctccgtgggcagctgctctgttccagttcttgccacccttcatcaggagagaggtattgcattgctagcaaagttggattttcttaatgtttgtaacattaagataaattctggattaacaatttgtaatatttcactcagctgctgctccaccaagaatcagataactctgcgcagttgtcccaagtttgtgattctgaatgcccaacaacaactcaatcaaaacttaatgtaattattggtgttatagtgtcctattgttttcagattgacacggagcaactgctggcccatctagtagaaacagaaatgataaagagaacggtaatttccattcttttgctatttcttgttttttttttccttctctgaacctctgtccatagtgattggggatgtttgatatttcagaaagaaggaaggtacaagggaaggaagttcagttcagtatgtcatttctttggatatcaggctcgaggatctacaccatcaaatttcgactgtgactatgcttatgtgagtactatttcactgagattttggaaaactgaatgttctgatgatccgatccttatgttattcatgctaacactgaacattttaggctcttggacgtatctccctgcatatgattgcagttggattgactggctacatggcaactgtggctaatctgaaagaccctgttgacaaatggagatgtgctgctgctcctttaactgtaataagatgtcactgaccatgccttcaagatcagatgctgaaaggttacttatctatttatgttgacctagttgcacaatctgttgtctctaccaggcgatgatgagtgtgaagaggcatttacgtggccctggagcaatccctatagggaggccttccattcacccttctccaattgacctgaaagggaaggcttatgagtaagtccacattgttcagggctttgatacctggtcctgcttttttttcccccgataagtagaggaaaggatgcgacctggaaggaaggtgaacgggattgactttgttcctgcatcattcaggttgctgcgagagaaggcttcaagcttcctccttgacgacttctacaggactccaggaggcattcagttcgaagggcctggttcagatgcaaagcccatcacgctgaccattgagaaccaggactacatgggtgacattgagatactgaaagagtaccttggcaaggttgtgatcgggaatcctttcatctgcttccgagtagtttcagattaaaaagaaaagaaaaaaagcttttcatttaagaagcaggtcccttcctaacattggcatgcccaacgatgatgtggtcccaggttaggaccatggtgaagccagggtgctcccgggagatcctgaaggcggcgatcagttccatggtgtcggtgacggatgtgctgactgtgatgtcccaccccctcaacgccgagctgcccctctaccatttcaagtgagcgagggcatcagtctggttgttattcctagagtgtttttgaaacagcagaagattctgcttcatggctgccggtcttctttttttttaatttgggtgagaattaagcaatgggttgtactaataaacactgaaacagtacttgatactgaactgagtcgcgtgctagttgtattattggtggcagtattccagttttcaagaggtctctagaatatccaagattgataacactcatctttcagcctagcaatatagtagtagttctttctttacttactattaatgcactttctctcctcgcaaagttaagaattgcccaaccacctcttcttcctcgctgccctccaaggtggccaagagccaacagatcgatgacagaaactacaaattaaaaacaaacaaataaaaaggacatgcatgacctgatcaccacccatctcatagagagttttttttatcaccacctgaccaccaaccatctcctagagaaggatggatcgacaaacctttttttaaagtaatcgttgcaggaggttgcaatctagcacagggcagtctggtccgactccgctgcttgccgcgcctcgccgaggtgccggctccacgctgctagagagatgaggcacatgtgaaggggcctgccgctccgctcggcctccatatgtcgggcgtttttcagcacaaaagaaggatgcggatgcggaaatcttctggtttcggtagcgtggcctaaagtcgcgtcatgataggaggaggctgtttccagcagacttgaatacgatgcggagaggaatctggcagttgagactcaacgcatatgcagaaggagagccaaacatgcatacactcgatgcatctcgtacggccccacacgagagccacgggcgtatttggtttgtgcctaattatgtcacactttgtctaaggttagtcgttcgaattgaataactaacattagacaaagtgtgataaattagacatcgaaccaaacaacccttgattttgcctaatgcatgaccatgtgaatctctcggttgaatgtgtgtttccattttgcattgccacacaacactgtgccaaaacacatttggactatttgcctcttaatttcgtctgtccactaatttcgtctgtccacgttgggtttagtctaagagagaaactacatatatgtggatctcgttgttttatctg

SEQ ID NO: 752 - protein, 618 aa, Zea mays
MNADFGAPKELAGGLQQRRALYQPRLPPCLQGPTVRAEYGDATTTIDPTCAQAVAQPFPHTFGQPLVSFVAPAAGAGAVEERHPIRVGVVFSGRQSPGGHNVVWGLHDALKAYNPQSLLYGFVGGTEGLFANKTLEITDDVLASYKNQGGFDLLGRSIDQIRTTKQVNAAMTTCHSLNLDGLVIIGGVTSNSDAAQLAETLIQNNCKTKVVGVPVSLNGDLKNQFVETTVGFDTVCKVNSQLVSNVCLDAISAGKYYYFVRLMGRKASHVAFECALQSHPNMLILGEEVALSKLTLMEIISKICDGVQARAELGKYHGVLVIPEGLIESIPEMYALIQEINILHNSNVPVAEMSSQLSPWAAALFQFLPPFIRRELLLHQESDNSAQLSQIDTEQLLAHLVETEMIKRTKEGRYKGRKFSSVCHFFGYQARGSTPSNFDCDYAYALGRISLHMIAVGLTGYMATVANLKDPVDKWRCAAAPLTAMMSVKRHLRGPGAIPIGRPSIHPSPIDLKGKAYELLREKASSFLLDDFYRTPGGIQFEGPGSDAKPITLTIENQDYMGDIEILKEYLGKVRTMVKPGCSREILKAAISSMVSVTDVLTVMSHPLNAELPLYHFK

SEQ ID NO: 753 - DNA, 6581 bp, Zea mays
aagtcccttattattatttatgttaggcctgccagcagtcctatgcgaggtcagcaactaaacaagcccctaaagccttccctccatcgaatgctaccaccgagtgaccaatttgaaagcatgacaaactgttgcaaatgatttctaaggccaaggatacataccgcgatcctcataataacagtagtaatagtaataccagtaatagcagcagcagtaaataataataataataataataataataataataataataataataataataataataatggtggtggtggtagtgctagtgacgacatcaactaggaaaacaaacaaacttaggactgtttggatctctggactcatatcaaatgtttgaacactagttaaaaatattaaatatagtctaattataaaactaattgtatagatgaagactaaacgttaagacgaatctagtaagtctgataagtctatgattcatttatatgatgctacaataaatattggtaaacattgactaataggtttaataaatttgactttcagtttagtcttcttctatgtaattatttttgtaattagactatatttaatgcttataattaacatttaaatattaggtgtgatacatattaaactttagtcatgaaccaggctgcttaaattagccgatgttgtagacgcgagatcatttaagacgtgtttcgttccatccaattaaactttaatttctatcacattgaatgtttaaatgatgattatagatactattaaatataatttaattataaaattaattacacagataaagactaaaagaaaaaaattattatacctaattaaggctatatttaataattataatgatatttaaatatttgatatgatataaactaaactttatctttattctaagtcttgtactcactgtcacgagaaaaagaaaagaaaacaaaattaagatcccgtactacaaagagatgagttaaaatcgcacagccacacgagcagtctgaccaccactaccttccctatcagaccgacagaccgtgtgtcagtgtgtggcctcactcactcaccgatccctcgccaagccacaggctccccgtgagctccgccacgcgggcgcctcgcctccttcgtccttcctcaccgcagtcagcaggagcaatggcgatggcagccatagcctccccgtcgtcgaggaccctgatccctccgcgacaccacggcgccgcgccctccccgtccacctccggcgactcctcgctccgcctcctctgcgcacacccgcgccacggacggcgcggccgggcgatgtccgtctcgacgcccgcggcgcggagccggccgttcgtcttctccccgcgcgcggtgtccgactctaagagctcccagacctgcctcgaccccgacgccagcacggtatgccccgctgcccacctcactgcacgggaacgcggaggtttctcttggcgcgcctggacttctctcgcttgcggcttgcctctgatccgtcgggttgcgccttcgaggcgcatttgccgttcctgatgggagattgggacgcgcgcgcaaaagattgttttttaatctttatgaataacgcgttgctcatctagatgcgcagatcggcggctgggattgtcgccttctcatgtgcacgtgtctgctgcttagtgcagtattttctatttgtatgtattaggtaccgaaagaatgaagcaaagcaactttatgatgccagtagttgcgaggctcgtgtcgttaaataggagtacttgtaggagccactatccagtaataaattgatcaagatgttgtgagggctgtagttgttggtatttttggatcatgacttatttatttaatcgtttcttcttcccatataggatattagtttttgggtctgatgcagaaattatattgttgcatttatcctcgagtggcctctgttgtttgaacttgtctgtgtcccgtcttttaaatttgtcgtgatgcagaaattatgtttttagtttccaaggagtgctaatagattttgaatttcagagctgtcagtgtccatttctgatgttcactcttggctgtataccataataacacacatttgttggttggttcagagtgttcttggaatcattctcggaggtggtgctgggactagattgtaccccttgacaaagaagcgtgccaagcctgcagtgccattgggtgccaactatagactgattgatatccccgtcagcaattgtctcaacagcaacatatccaagatctatgtgctaacacaattcaactctgcttccctcaaccgtcacctctcaagagcctacgggaacaacattggagggtacaagaatgacgggttcgttgaagtcttagctgcacagcagagcccagataatccaaactggtttcaggtatccctactaatgctgtgtcttttctgattttctcaaatgtgaaatctgccatttcgttaacatgcacatctgacaccatatttacattttctccattgcatattctcacttcgcactaccatcaaatttgtaaccaacagagtacagacaacaaaggtcattccagttggttattgaacatgagtttgaagtgtaccatcatgccttaagcaaatgcatgctaatctacaggaaattttgttagcgcacttcactagcttactccaagtactgattttcttttatattttttctcagggtactgcagatgctgtaaggcaatacttgtggttatttgaggaacataatgtgatggagtttctaattcttgctggcgatcacctgtaccggatggattatgaaaagttcattcaggcacacagagaaacggatgctgatattactgttgctgccctaccaatggatgagaaacgtgcaaccgcatttggcctcatgaaaattgacgaagaagggaggattattgagtttgctgagaaaccgaaaggagatcagttgaaagcaatgatggtacacataatttgccttttctttcaagctaacttgacatacatttgttgacaatcatttagtgaacctaaaatattcccctttaaaatgccttcatctcatatttctgtctgattgatgtaggttgacaccaccatacttggccttgatgacgagagggcaaaggaaatgccttatattgctagcatgggtatatatgtttttagcaaggatgtaatgcttcagctcctccgtgaacaatttcctggagccaatgattttggaagtgaggttattccaggtgcaacaagcattggaaagagggtatgcagagattatataaccttttagctctttgttttcttcggtttactgatgtttcctttttgtaataaaaagtatatagccctttcacacaaatgtcagactccataagttggtaacctagcatttcatttctgaataaatttactattatctaaacacttacattggagtgcatatctgtagtttatgtgcatcaagtgtttcctaagaacagcatgctagaaagcctaggcaggttgggttggctcaaggccggagggagggaagggttacaccttttaaaatggtatttaagaccttatttttgtctgcaggttcaggcttatctatatgatggttattgggaagatattggtacaattgaggcattttataatgcaaacttgggaataaccaagaagccaataccagatttcaggtatgcacattttcacttctcactgtgctgcagtagaaagttacaacgccgcatgcgtgtcaaatcttataatttcaattagtccctgctgatttagcgtttcccttcaatctgaatacagcttctatgaccgttctgctccaatctatacacaacctcgacatctgccaccttcaaaggttcttgatgctgatgtgacagacagtgttattggtgagggatgtgttattaaagtaagtagtgttttgttttactatagcatatttgaaaacctatatatagactttatatcctccaaagtatttttcccgtaattcatttactaaaacatttatgccttgatcttgtgcacacagaactgcaagatacaccattctgtagttggactccgttcttgcatatctgaaggtgctatcatagaggacactttactaatgggtgcggactactatgaggtaaatatatacaagtgtacactgctgccaatgcaacaagagagctcacaccttggcgttcttcttttccagactgaagctgacaagaaactccttgccgaaaatggtggcattcccattggtattgggaagaattcacacatcagaaaagcaatcattgacaagaatgctcgaattggagataatgtgaaggtatttcaaactgatgttctaacggtcaagaatatattggtctatttttttaccttaagataccacataatacttgatatgttattttctcctcttaatttctgcatttatttcgaaaatatgaataattttgcatgctctcgttttttacatggaagatgcctatataatatggctgtccatacttatctttccccaattgcctgcataaatcttcatcctgcacatttgcatgtatttaactgagctaatcaagctgaggtcccgttttccacgagataaaaactgtgaacaagtcatatcagttttttgttataaaaatacacaataaaacctgaaatgcagagcttcatatcagtttgtgctttggctttgcaatactgcccatgcatatgccattcaagttccacccagaaacagctgccattatcctgtaatcttgatcctattccctttctctgttattgtcattgtttgatagacctgttgcacttgattattcataaatttaagttgtcatgagtcatgaccagatgagtcagatcatctgatgagtcagataagtcttagcttgtaatatgattaaacacgaacagttcattattagacttgccacacattttatatggccgtgatatttctcacgagactcgtcgatcttgcagatactcaacgctgacaatgttcaagaagctgcaagggagacagacgggtacttcatcaaaggtggaattgtcacagtgatcaaggatgctttactccctagtgggacagttatatgaagtaagctctctccccctgttcctacacaaactgctgtcagtaaagcttcacatgcaaagacttcgaaacacatctcactcaaaatattgaatcaactaggttgcaaatgttacatctttgctcgaatttgcaagcctgcctgttcacaagatcactgttctgtactgtgctgcaggcggatgtgcgacatgcaagccagagtgtcatcgacaatgatcagcatctggttacatgcctgatctgcagttcagtgtgctggagatcatggaaacaataaaatgtgtcattcaaggcactttttctctctctctgatcttttgtccttaaatgttgtgggttatatataatgttgtagcagaaacagttagtacaatgctgaatcaaaactggatggctggatttgggatacatcttcgatgctgtgtcattgatcagtttaattaccataccgtgctgctttgagcgaagccataaaggccatgctctgcttattgtgcgtacgaacagaagcgtcgctggtttgcagatttggatctactcgccctaatagttagtagccaatagtccctccgtttcgtttgacaatattaccctaagtttaaccggtttgtcttattaaaaaaattcataataattattataaaatttttcataataattattattaatttttacagtgatattgtttagtatataagtatggctttgaatttttctttttttcgcgattgcgatggagtagctaccaactattagctagctagttattactttgatccacctacttataagatacttaatactcctcatctcaaattaaagttcgttttagttaattaatgttttagttaattaatggattcatacaatatttgatgtaagtgtctagatttatttttattcaatcaaatatagacataaaattaagaactaaaatgattactattttgaaacggagagaacagagggagtagttggtatctgttaattcctattagcagctgtaaacctgctaatgaaatttcgctagaaacagtttaattttcataagaaaaatggaaacattgagttcaaagaggtcgatgctccagaagcatctgcgtcaaattgatctttagacaatgtttctttccctaggagattaaacatgaagcttataatcaaagctgtatgcgagggagatcaacaattcttttaccagcgctaaatgacttttgagctccagcacaagctcaaggtatgtttcttttaaaaaaatacaatggtcttacagaatacctaaacattgacatacaaggtgtttgcatgtcaaattgtacttttgaaccctacatgctaaaaccatttttaatacagtttaggaaacttcaaccagaccttttttatttacataccaaatccatttttaatacagtttcagaaacttcaaccagaccttta

SEQ ID NO: 754 - protein, 517 aa, Zea mays
MAMAAIASPSSRTLIPPRHHGAAPSPSTSGDSSLRLLCAHPRHGRRGRAMSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNDGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGDQLKAMMVDTTILGLDDERAKEMPYIASMGIYVFSKDVMLQLLREQFPGANDFGSEVIPGATSIGKRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRKAIIDKNARIGDNVKILNADNVQEAARETDGYFIKGGIVTVIKDALLPSGTVI

SEQ ID NO: 755 - DNA, 9529 bp, Zea mays
tcagaagacatccagccctaggctaggcgcacggcggcacgggaggcagacgaggcgagaagtggcaactggcaactggtacctttggggaggcgaggaaggacacgaggtcggtgcgttcgtgcgtgcccttctcactgcacgccagtgagaattgagatcccagcaccgagacgacgacacaagtctcacctccatcctcctttactcctcatcctagatccctctctccgaaccccgccgcccgccgcagatccgaaggtcattggcagccatgatctcgtccagcaagctcaagtccgtcgacttctacaggtgcgttcccgatccgttctccctagatctcaagagcacctccactcctcgcccctttccgggatagactgggatggtgcgattccctggggttggattgaatatatattgctagtctagaacggagagtggtttcgtcaggttgggcttggcggatttcgtttgggtgagtcctggatggcagcggtgtgtgcctcgcggcgaatgcgcattttggcggggtactctgcgtcagcgagagggtatcctttgtctgtttctagctgggtagagacgagagacccgcacgatgaatcggtagctgctgtgttcaaaatgttggtgtgtgagtctgacatctgtaattgcatcttgactgttactgtatatttcgtttttgtgagaaatttgctattttgccactcattttggcttttgtagtggtgcttcggtttgtagtacgtgttacactctggtgggatatgccattctaataaattctacaccctcattgcaaattataagacgttctgtcttttttttagatacattacttttattatatatgtagacatgatgtagatctaagtgcatatcaaaacctatgtatctaaaaagagccacaacatcttataatttgaaatggaggaagtaaaatagaagctaattggacagttttggattggatggcattgctttgtctgcttgcagaagctcgtccttagtaagggtccgtttggatcccaagagctaaagcaaaagtgactatagtttagtcatttagtggctaaagatccaaacacgaagagctaaaagtgactaaaatggtcctaagcatacttagccagtcatgccaaagttcttttcataccattctgtttctgttaaaacaaataactgcttattattcagacgttatacattcatgctatgttgaactattgtgcaagggtctgaaccattattgttatgatttgaaagttgagtagcttacactatttagtttttcgatgtatcaatcacgttcgatcagaaacttattgttatcaatagtcaacctttgtttgagcaagctgttagtccttgatttgcaagtccccagaataataaactggagattaatttgattcagaatggctgactttttctgttctctcctcagttacatttacgtgtggtgaaattctatgatttctttgtatctactatctagtaataatttgtagactatttggattcagaatgactaactttctggttactgttttctgagtttcatttataactgatgggtttagtttctctttctctttctagtagtgaatgtttggatattttttcatcttgcaggaaaatacctagggatttgaccgaggcatcactatctggcgctggattatccattgtagcagcattagcaatggtttttttgtttggaatggtctgtttttttgttcccccctcagtttcgtctgtaatcagttgcagtagttgctggcacttctttttctgtcaaagacttttagcaccaaaaaattaaaagccagcatgataggtcttctttcatgctccaattggtggttttaaacaagtgtatggaaatgaattgggaaaatgattgaacttcactccttttgtttatgtagaattgcagatataagtgcattatcatttggttttctgtagcatagttgacttaagtaacaatgtttcattcctcactcctattgtttctgtagcatcaatgttttaattgattcaatcttgttatctgtttcacgttcaattgactattgagattagaacatcgacaagatgtgctagattctaaagataattatgactgggtgagcttcaagctaatatggtcaaattttgatttagatttgtcaattgtgctgtactaaacattgaaagtgatggtttaggggggtgtttgggactgctccagggtccaactccagcatggggctgtagtttataatataaatttaaatagttttaaaatcatttttaatttgaataataagtaaaatgacttatttaaatgtcttcttctaaaggttcacaactccagctccacgattttctggagcacctaataacctactctgctccgccaccttcaccaatttttctaaagttggagtagtcccaaatatggccttagttacattctaacattctgtatccaaaatattccacttagacacactaaacatttcagttacattttgtatcctaaatatttgttgctctgaatccaatacatcgtgggttgacattttttaaatattgcaatgtgctttacatgctagcagtttgaagttgacttgatttctcattcaagatctgcgggctttatctttttcaatggtggactttgagttttgaactaacacaatgatgatttgatattgcaggagttgagcagttacttagcagtcaatactaccacatctgtgatcgttgataggagttcagatggggagtttttacggatagatttcaatatgaggtaagccctatggcatccctcaagtgttgttcagtttggtgttaaatatagcaatatgttatctacttatgtgcccgtatggccgtatggttggatgtattacattgctacctgttaaactttccacatgggtttgcaatttatggaaattggtggtttcctgacttatgtctgctctgctgatactaattatttgatgtcataattataataagctaatgcaaatgcctgcttaagacaaatgagttcatgattctgagtagcatacaacactctaaagaaaatcatgtaaccttagacttagagaataacttctagtttttagtggctagtctaatatctaccttccccccctctaacgtgtttacagaatgaccttaccttcttctgttatctattatcccgtacccctctttttcttggataccatattgcctgagataacatgatctatcagagaatctaaattctaatgcccagggaaagtgtgaatagtaggggggacacttctttttcgtttgtactttatatcattatattgttaaattagttcttgctggtcatttgtgctcttttctttgaaacgaaccagacagaagagctgccgattatattaataaaggagaagggttcggattggacaaaataacaaaacaacaaacaataggcagttggattgggacatcaacacgccgacaccatacaaactcaacccgccggttcgattgggacatcaacacgacacaacactcaccgcctacacaatgcacaaaacagcccagacaacggaagcccccccccacacacacaacccatccagacttgacttatcgttgccgagctcgacctaagggacaagcagctccgactccgcaagacgggccacacatggccaaagaaaacacgacaacacctataaccaaacaccggcacagaaggaggaagatcgcggtgcgccgtcgttgcaagcctcaacacaccccacgcgaggcagctccgattcttcaccaacgagcttgaacctccgtcgtgcccccggcagatgcccgaacctacgaaccaattcagtccacgaagaaggggtctcgacaggtgtcatcgttgtcgagccacaacctctgatgcagcattttcgagttcacgctgcaaaggcccaccttcacctgcatgccagacgccgagaagcgaaagcaactaccgaaggcgaatccgaggccgagacaaacttcaggaagggagtgacgttggggacgacaccgtcgcgagtccgagatggatcgggctttctcccaaggaagacaatgctggggaatgtgacgcccccaacaggggaagcggcgcccacgggtgtcgccgttgccgaggcttttgcccaagaagcccccccagcaccaacgtccggccaagaaccactgtcgccgccgtccatacatcccgcaagaaaccctccagaggggcgtcgacgcgatggatgccgcaccagccgcaaagccgtgtcggccgccacccccactggcctggcacacagaaccggacaactccttgccacgtgtgtcacactggcgcgtgcaggagctgaagccggtagccgctgatggccctggcacacgccgccaccgaagccagttgccgccggacgaccatgcttccacactgcaccacaagctccgcggcagcaccacgccgccacagcaccaccggccgccgccgcagcctcccactagaaagacatggatctgcgtgccgggagacaacatctgcctaggggcagacggatctgggcgcagcgggccacgccgccggacgtcgcccccatgcagtcccatgcttccacactgcaccacaagctccgcggccgcacaaccacaccaccacgccgccacagcaccacaacctcccctactattcacagtcatttgtgctctggaatgtttttagggaatcaagatctactactactactaccttttttttattcaattgttaccattttgtttatttgttcctttctccttggttcatgtggctctttgttggtttcatctctggcatacaccaaattacttgggatgaaaggatttggtgttggttaggaatttggattgatttcatcaactctggactgcaaaacttaactattgttctctcaaatatttactgaccacctttgtgttttgcagctttcctgcgctttcatgtgaatttgcatcagttgatgttagtgacgtgctgggaacagtaagatatatctttgctcatatgttgtgttttggttatagcctctagaatatggcaaaactcttagttgatatccttgaagataatgaataaagtaaaacatcagagacatcttatgatttgtggaaaaataaagaaatgttgaagtcttcatgtacattagcatgcacattaaaaatcatttgcactaccttttgtaaactatgtatatatctgcacatcacatcatctttttttgtttaacttaagttatctgttaattccatatgcagaacagattgaacataacgaaaactgttcgaaagtattcaattgatcggaatttagtaccaactggatcagaattccaccctggccctatccccattctcaataagcatggagatgatgttgaagaggatcacgtggatggtgcattttcattgtcatctcgcaattttgatagcttttcacaccagtaagcattcagttatctaccaacctacagtcctgcttgatcaagcattagtcattttgtattttaaaatcggcagtgaccattatttgtattattctagtcataaccacctttttggtcaacatttatgtctcactttacatccattgtatctcaatagctccaattcttttggctagattttttatgacaaagcatctctgtttttgtgttaagattttttggatcgaatgtttacgcagtatttgacctgtcttgtattttttgtggaaattatagcactacattgcaacatgaatgccaaaatagcattggctttgtctgacatgtgggaccaggtcctacatgtcacacatttcgatggtgttttaacaatcaagttagtaacttactaacttgtggtacagaggcgacatttccatctcttaatattgcttgtagtgttcagaaggcgtcacctagctttgcctagatgtaggtagagcagcactacctcacctaggacctaggcatttttaccgccaaaaataaaaaataaatagaattgtctacttgtctaggcacatgtaggtgcttgggtgcctgaccgcctgcctagcacctagcacattttgaatctttggctttgttgatagttatcctttttcttgaacattttttgtacttacttatccttattttgttcctttgcagatatcctgttttggttgtcaacttctatgctccctggtgttactggagcaatcgactggtcagtatttatttccttgtgttctttttcatttctttatgttcacaaatcacaactttctgtggcaacaagccaacaattattgacttcctgtatggtttactgtgcaagtcatctggacataatgtacaggatgcttagccttttatgtttttattccagctgaaatatatctgtggttttgcgttctgttgatttcaaatatttcttagcacttgtttttttccccagaaaccttcatgggagaagacagcaaaaataatgagggagaggtaaatgctgttattctgtatatgcccctaataaggtttcacgatgaatatcttgcataatcaattactttctttctgatcatgtgcagatatgaccctgaaatggatggtagaatccttctaggcaaggttgactgcactgaggaagttgaattgtgtaggaggtctgtacctaattatacttattacattcaggaccaacacgatttttaaatgtatatgatgtggtctgcaatcaaatcattgttagttactataattttgtcaactagttacaaagtctctgaataagagggtattatagtgtcaatctaaattctaaaaaatggtaatcatgatgctattgtgtttcataaattacagtgttatatgcactccatcttggttctgtagtagctattctttctggaattagttcattgagatctagttcttctggtaccaagtttcaatcaaagatctgttaagattaatatggaattgcttaaggaaaggttccatgtaaagctcatgccttatcggtacaatttattcagaccacatttatttgatattttttgactatccgttttgttgatctctggccttgttgttggccattatggcttcaactttggaccttgttggtccatacagttcctgtaaactatctgtcatttgtaaataaatgcagtttttatgtgttccaatatattgttggataaaaagtgggaaggggcctggtgctggggatgctgtttaaccttgccctgaaacggtttgcacctaggggtgttgttgcccattttcattagtgattgtctgtcttcataaacagacagaaggggtgccaggctgcctttatatatatatatatatatatatatatatatatatatatatatatatatatatatatatatatatatatatatatatatatatatatatatatatatatatatacatatatatattgctggtgttataatacgcacatttcaaactgcacatattgataacttattgttgaccacaagagaaatctagagaatgtttcttttcttttcattcacatcatgacacttgtatgtacctttataacatttttgtttgtgattttactgatatatctgaataagtaaatagctggaacatacttttcattactttaattcatcaaatgcagaaaccacatacaaggatacccatccattcgtgttttccgtaaagggtctgatataaagtaagcacaagccttcttacattctatttcgatacttccagttttatttgtagcatctgggttttgtttaggtagcttccaagtatatgctaattaggctgcaaacatttgtttgttctatatttgtgatatttgcactagttttatagaaggaactccctgttttctctttgcgcagggagaatcagggtcaccatgatcatgaatcatactatggtgaacgtgatactgagagtttagtcgcggtatgttatgcatcatctggtttcagattaattgcggttggactgacttaacattttatatgatactatatcctaagcatcatgcatggggaaataaaatagcctttaagaggctactacattatctattgttggttgtgagcaaattcctgatgtaatgttttgaacctcaggcaatggaaacatatgttgcaaacatcccaaaagaggctcatgctttggaagacaaatccaataagactgttgatcctgcaaagcgccctgctccaatggccagtgggtgcagaatagaaggctttgtgcgtgtcaaaagggtaaacgagctacacttcaaaatcacatagataattttgtgctaatggttggtaattcgaagatgggtgttttgctgaccttaataataacttgtcatgtttaccaggttccagggagtgttgttatctcagctcgatctggatctcactcgtttgatccatcccagataaatgtttcgcactatgtgacacagttctcatttggcaaaagactttccccaaggatgctgcatgaattcataagacttactccctatcttcgtggataccatgatagactagctggccagtcttatactgttaagcatggtgaggttaacgccaatgttactgtaagtccctaactttttcttatttttttactaagattgtatggtcagcttcagtttcttttgagcgggtgatacttcttgtttcttatggataacatagattttgtttcttctgtgctaatagattgagcactacctacaagttgtaaagactgagcttgtaacacagaggtcctcaaaggaactgaaagtgcttgaggaatacgaatacacagcacacagcagcttggtgcacagcttctatgttcctgttgtgaaattccattttgagccttctcccatgcaggttcgcatgcccatatctttttagtttctcatacgttttgttttcattaacaagtgaatgatttatctaaaaaggttcacatttaaaggtcttggtaactgaagtcccgaaatccttctcccatttcatcacaaatgtctgcgctatcatcggtggggtcttcacggtgcgaacacatccttgcttttcacatatgatctttatagtcaatcaaaaaaaaaaagtctactgaaaactgacatgcaaattctaggttgctggaatactggattccatctttcacaacacactcaggatggtgaagaagattgagctaggaaagaacatttaaatttcgacgccgctgcaagtttaggcggatgcactaggtagccattgttttgttataactaggtaatgactcatgaaaatcggtatatgaaagatggcgtgctgaattgacggttgaaattcggggggtcatgaaatcatcatataataactagggatctcactgtttcgctaaaccactcacaataagacagtggattgctgctagtgtgccactgtgataagtaaccgagttggataatatattcagtatattatcttgccgtg

SEQ ID NO: 756 - protein, 173 aa, Zea mays
MIRPAPWVGAGHRGRGGEAGACTESLGSESGDVGCDAAEIDQFFPPAPAAGGPDDAGAEPCIPDLAAAAAAGKRRRGGFPPPMPRASGPLFLRAERRGGRLILTEVRADERERRVVFRAERDGGRLRLRFANDGDGPEAAGGGGGAGGGGGELCQVAAGRRGVQVGAVMMGAI

SEQ ID NO: 757 - DNA, 5866 bp, Zea mays
gttcgtgtggcagattcatctgttgtctcgtctcctgtgcttcctgggtagcttgtgtagtggagctgacatggtctgagcaggcttaaaggttctgtttggttcagcttttttctgaccagcttttctgaaaatccggctgtggggagaatctggctgtggggagaatctgagtattattacgattacgtgtggaggaagataaagtatttcatagggctcaggatttagaaagtgacagattcctactattacaacgactcaaccgattatatgtttatgttgattttggatggtttttgcccccaacgaattttatagaagctggctgaaaagtgagtgtttggcagtctgcagcagcttttggtggccagaagctgctagaagccgaaacaaacagggccaaaatttgctcgtagacgaggagtaccagcacagcacgttgcggatttctctgcctgtgaagtgcaacgtctaggattgtcacacgccttggtcgcgtcgcgtcgatgcggtggtgagcagagcagcaacagctgggcggcccaacgttggcttccgtgtcttcgtcgtacgtacgcgcgcgccggggacacgcagcagagagcggagagcgagccgtgcacggggaggtggtgtggaagtggagccgcgcgcccggccgcccgcgcccggtgggcaacccaaaagtacccacgacaagcgaaggcgccaaagcgatccaagctccggaacgcaacagcatgcgtcgcgtcggagagccagccacaagcagccgagaaccgaaccggtgggcgacgcgtcatgggacggacgcgggcgacgcttccaaacgggccacgtacgccggcgtgtgcgtgcgtgcagacgacaagccaaggcgaggcagcccccgatcgggaaagcgttttgggcgcgagcgctggcgtgcgggtcagtcgctggtgcgcagtgccggggggaacgggtatcgtggggggcgcgggcggaggagagcgtggcgagggccgagagcagcgcgcggccgggtcacgcaacgcgccccacgtactgccctccccctccgcgcgcgctagaaataccgaggcctggaccggggggggccccgtcacatccatccatcgaccgatcgatcgccacagccaacaccacccgccgaggcgacgcgacagccgccaggaggaaggaataaactcactgccagccagtgaagggggagaagtgtactgctccgtccaccagtgcgcgcaccgcccggcagggctgctcatctcgtcgacgaccaggttccgttccgatcctgtccttgagtttcgtccagatcctggcgtgtatctacgtgtttgatgatccaggttcatcgaatctaaatctgtccgtgcacatgtcttctctctctctgtctgtctgctatgcagtggattaatcggcatggcggctctagccacgtcgcagctcgtcgcaacgcgcgccggcctgggcgtcccggacgcgtccacgttccgccgcggcgccgcgcagggcctgagggggggccggacggcgtcggcggcggacacgctcagcatgcggaccagcgcgcgcgcggcgcccaggctccagcaccagcagcagcagcaggcgcgccgcggggccaggttcccgtcgctcgtcgtgtgcgccagcgccggcatgaacgtcgtcttcgtcggcgccgagatggcgccgtggagcaagaccggcggcctcggcgacgtcctcggcggcctgccgccggccatggccgtaagcgcgcgcaccgagacatgcatccgttggatcgcgtcttcttcgtgctcttgccgcgtgcatgatgcatgtgtttcctcctggctcgtgtatgtgactgacgtgtgtgttcgggcatgcaatgcatgcaggcgaatgggcaccgtgtcatggtcgtctctccccgctacgaccagtacaaggacgcctgggacaccagcgtcgtgtccgaggtacggccaccgagatcagattcagatcacacatcacagtcacacacaccgtcatatgaacctttctctgctctgatgcctgcagatcaagatgggagacaggtacgagacggtcaggttcttccactgctacaagcgcggagtggaccgcgtgttcgttgaccacccactgttcctggagagggtgagatgagatctgatcactcgatacgcaattaccaccccattgtaagcagttacagtgagcctttttttttgcccccgcctggtcgctggtttcaggtttggggaaagaccgaggagaagatctacgggcctgacgctggaacggactacagggacaaccagctgcggttcagcctgctatgccaggtcaggatggcttggtactacaacttcatatcatctgtatgcagcagtatacactgatgagaaatgcatgctgttctgcaggcagcacttgaagctccaaggatcctgagcctcaacaacaacccatacttctccggaccatacggtaagagttgcagtcttcgtatatatatctgttgagctcgagaatcttcacaggaaacggcccatcagacggactgtcattttatactgactactgctgctgctcttcgtccatccatccatacaaggggaggacgtcgtgttcgtctgcaacgactggcacaccggccctctctcgtgctacctcaagagcaactaccagtcccacggcatctacagggacgcaaaggttgccttctctgaactgaacaacgccgtcttcgttctccatgctcgtatacctcgtctggtggtggtgcttctctgagaaactgaaactgactgcatgtctgtctgaccatcttcacgtactacctaccagaccgctttctgcatccacaacatctcctaccagggccggttcgccttctccgactacccggagctgaacctcccggagagattcaagtcgtccttcgatttcatcgacgggtctgttttcctgcgtgcatgtgaacattcatgaacggtaacccacaactgttcgcgtcctgctggttcattatctgacctggattgcattgcagctacgagaagcccgtggaaggccggaagatcaactggatgaaggccgggatcctcgaggccgacagggtcctcaccgtcagcccctactacgccgaggagctcatctccggcatcgccaggggctgcgagctcgacaacatcatgcgcctcaccggcatcaccggcatcgtcaacggcatggacgtcagcgagtgggaccccagcagggacaagtacatcgccgtgaagtacgacgtgtcgacggtgagctggctagctagctgattctgctgcctggtcctcctgctcatgctggttcggttctgacgcggcaagtgtacgtacgtgcgtgcgacggtggtgtggtgtccggttcaggccgtggaggccaaggcgctgaacaaggaggcgctgcaggcggaggtcgggctcccggtggaccggaacatcccgctggtggcgttcatcggcaggctggaagagcagaagggacccgacgtcatggcggccgccatcccgcagctcatggagatggtggaggacgtgcagatcgttctgctggtacgtgtgcgccgcccgccacccggctactacatgcgtgtatcgttctactggaacatacgtgtgagcaacgcgatggataatgctgcagggcacgggcaagaagaagttcgagcgcatgctcatgagcgccgaggagaagttcccaggcaaggtgcgcgccgtggtcaagttcaacgcggcgctggcgcaccacatcatggccggcgccgacgtgctcgccgtcaccagccgcttcgagccctgcggcctcatccagctgcaggggatgcgatacggaacggtacgagagagaaaaaaaaacatcctgaatcctgacgagagggacagagacagattgattatgaatgcttcatcgatttgaattgattgatcgatgtctcccgctgcgactcttgcagccctgcgcctgcgcgtccaccggtggactcgtcgacaccatcatcgaaggcaagaccgggttccacatgggccgcctcagcgtcgacgtaagcctagctctgccatgatctttcttctttctgtatgtatgtatgtatgaatcagcaccgccgttcttgtttcgtcgtcctctcttcccagtgcaacgtcgtggagccggcggacgtcaagaaggtggccaccaccttgcagcgcgccatcaaggtggtcggcacgccggcgtacgaggagatggtgaggaactgcatgatccaggatctctcctggaaggtacgtacgcccgccccgccagagcagagcgccaagatcgatcgaccgaccgaccacacgtacgcgcctcgctcctgtcgctgaccgtggtttaatttgcgaaatgcgcagggccctgccaagaactgggagaacgtgctgctcagcctcggggtcgccggcggcgagccaggggtcgaaggcgaggagatcgcgccgctcgccaaggagaacgtggccgcgccctgaagagttcggcctgcaggccccctgatctcgcgcgtggtgcaaacatgttgggacatcttcttatatatgctgtttcgtttatgtgatatggacaagtatgtgtagctgcttgcttgtgctagtgtaatatagtgtagtggtggccagtggcacaacctaataagcgcatgaactaattgcttgcgtgtgtagttaagtaccgatcggtaattttatattgcgagtaaataaatggacctgtagtggtggagtaaataatccctgctgttcggtgttcttatcgcttctcgtatagatgttatatagagtacattttctttctgaatcctacgtttttcaagtgtttttgaattaattcctgtgaaatttctatatcattcgtgtaaaatttctgggttccaaaaaagatcatagcctatctttgtgtatgcatggacgggtttggctttgactaggctaagagcatgcacaacctatatagatatttaggacattgtccacagtttctagtttcttgtttgattcacctacatttagctaaacagacagtttgcactgtctgcaaaaactatttaatgcttaatcaagcaactcggtaactaagtttcagattcaacaaaatacaaaaggtgctagaggattgatttggtatactggcgtaaaagatatactcggtagctgaccataattagcttcaagtgcaaacatatcctcttctttttaatagtcataaatagtttcattaaagtgaggtggcttaccaacatgattagttgccatctttacatcatgagttgctaagccttgaagttgatagttgcatggttccgataccatacaattcaaaggatgtagatggctagcggggataaataccctataattttttttacaaaccacaaacaatagagcaaattgattagtatgtattgaaaccccaagaactactactttctctagcattaaggttccctttggcagggctatctagacagctcctcctctggctcttcgtgaagccgtgtcaaatggtcttaaaaaatggctcctcatcgagagccatcaaggagctagatttgttttgctatcgggagatgaagcatcagaaaacaagcttctactggttttttctatcccacacacaataatatttcacaaagttacagtccctatcatagttttcccgtgaaaaatcgttttaccaaatgaattgcaaaacggcgctgactcctctagagaagccagaagagccgaacccgttttgagaataatcgaagccataccaaagggggcctaattcatccaagcaagcctcctacacaagt

SEQ ID NO: 758 - protein, 609 aa, Zea mays
MAALATSQLVATRAGLGVPDASTFRRGAAQGLRGGRTASAADTLSMRTSARAAPRLQHQQQQQARRGARFPSLVVCASAGMNVVFVGAEMAPWSKTGGLGDVLGGLPPAMAANGHRVMVVSPRYDQYKDAWDTSVVSEIKMGDRYETVRFFHCYKRGVDRVFVDHPLFLERVWGKTEEKIYGPDAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENVLLSLGVAGGEPGVEGEEIAPLAKENVAAP

SEQ ID NO: 759 - DNA, 2576 bp, Zea mays
tccaaaagtacgtccattgaatggtggagtaaagagtcatttgacctctcagaataaaattaaaatgagaataagtaagaataaaacatctctgttctcaaatctaggccatacaaacattgggtattactaaaaaatagctaatgccatctttcaacatttggaagttaaaaccaaccaatcctcactcattcccaagaaatattggatcatatttaacattttgtgtcacttacaaaattggcttaatcttttatgcggcaatgccaaccttttttagcagggtgccacttgtaacatgaaaactataactattttcaaatagtaccttgaaattcgcattctatttttatgcattcttcaaaattgacacaaattatactaggagaattcaattcattcttgccataacatattctaatgcaaatattaagtagattgctcaacatcggtatacatcttttggacgattaattagtattgtctcactacattctttgttttagcagttcattaataatgcctcaatagcatacttcattttaggaactttatgaaaattgtcttaaaatagggccaagtcacaaatccacttcaaaggtgactcttcatttcttacttcctatcttcctattttagcagggtgccacttgtaacatgaaaactataactattttcaaatagtaccttgaaattcgcattctatttttatgcattcttcaaaattgacacaaattatactaggagaattcaatacattcttgccataacatattctaatgcaaatattaagtagattgctcaacatcggtatacatcttttggacgattaattagtattgtctcactacattctttgttttagcagttcattaataatgcctcaatagcatacttcattttaggatgaaaattgtcttgaaatagggccaagtcacaaatccacttcaaaggtgactcttcatttcttacttcctatctttgcttgtttttgtatatatatatgtgtggatggttgagtgatgttcctacaccactacaccactccttagacacatatatggaaaatagcttcactgtctagattccatggcatcaaggatgggaatggtggctattatgtcactatttgtttacgctattgttgttccaacgtcagttaatgctaatgcgtggcagactgatgataaaccaggtgttaatagaaacatggagatgcaacaacaacaaggtggatttattggccatcgtccaagacttgcatcttttaatagggcatcaaatcaagagggtgatcgaaaaagaactgtgcctagcgggccaaaccacaaacataacaacatcccatcgcatacccctcatcatccaccatcatatgtccaagctctttatgaagatgatagaactataacatctcctggtccgtccaaatcgataggccctccaccattaccagatagatactagttcatgcaaaagtagtgagtgtttatacacctatgccaatgaataacttctaactacccacatgtactggcctggtgtttggtaaacatgaagcaataatttcctcttatcaaaatacgggtctcaagctgcatgtgaaaaatgattttttttgaagtgaatgaaaaatgataaatatgaagcagtaaattttccagttgaaaaagtacatctctattattaacgataacctatatatcaatctacaatgcgctcatctgcatctcgatgcatactttcatcattttatgtttgcaatgtactttaatggtaagaaggattagattgttcttgttttcctcttattcttacctttttttcaaaattatcagtttccaatgtctgaatatgcaatgcattataaaccctagtcagcatatatcaagtcgatatatattgctatatgtttaagaactggtgttgagtatgtctactcaacatattttttagctattggatcgagcagtttagtaaaggtaaactacatttctctatcttcaagttgtattttccaaccttaaattatgaaatcgagtaacgctccactccaactgttgaaagggaacaaatttggtctccggactgatttcattggtggttctctattttttaaaacaacaaaaaaacatatttgttctctgaaaattgataattaattaatcataaattagaaaaaaaaactatatgaaactagttatagttttcttctaaaattattgtctgtctgttggtgctctagttatagagttataacatgaaaactatagccattttcaaatagtgccttgaaattcgtttttgtttttagccattcttcaaaattgccacaaaaccaggagaatttaatacattcacgccataacatattctagtccaaatgttaagtggattgctcaatataattatacttcttttggacgattcattagtactgcctcgttgcatactttgttttagcagttcatcaataatgcttcactagcatacttcatgttaggaacttgattaaaactgccttaagaacatggcaaagtgataaatccacttcaaaggcaattattaatttctta

SEQ ID NO: 760 - protein, 125 aa, Zea mays
MASRMGMVAIMSLFVYAIVVPTSVNANAWQTDDKPGVNRNMEMQQQQGGFIGHRPRLASFNRASNQEGDRKRTVPSGPNHKHNNIPSHTPHHPPSYVQALYEDDRTITSPGPSKSIGPPPLPDRY

SEQ ID NO: 761 - DNA, 3 bp, Zea mays
  misc_feature (1)..(3): n is a, c, g, or t
nnn

SEQ ID NO: 762 - protein, 176 aa, Zea mays
MKLLQALCPLVILLACSTSNASVLQDACKSFAAKIPDTGYAYCIKFFQADRGSAGADKRGLAAIAVRIMGAAAKSTASHIAALRASEKDKERLACLSDCSEVYAQAVDQTGVAAKGIASGTPRGRADAVMALSTVEDAPGTCEQGFQDLSVRSPLASEDAGFRKDASIALSVTAAL

SEQ ID NO: 763 - DNA, 8 bp, Artificial Sequence
  synthetic construct
cacgtggc

SEQ ID NO: 764 - DNA, 8 bp, Artificial Sequence
  synthetic construct
yacgtggc

SEQ ID NO: 765 - DNA, 8 bp, Artificial Sequence
  synthetic construct
bacgtgkm

SEQ ID NO: 766 - DNA, 10 bp, Artificial Sequence
  synthetic construct
gacacgtaga

SEQ ID NO: 767 - DNA, 14 bp, Artificial Sequence
  synthetic construct
ttdccwwwwwwggh

SEQ ID NO: 768 - DNA, 11 bp, Artificial Sequence
  synthetic construct
ccatttttagt

SEQ ID NO: 769 - DNA, 10 bp, Artificial Sequence
  synthetic construct
ccatttttgg

SEQ ID NO: 770 - DNA, 18 bp, Artificial Sequence
  synthetic construct
  misc_feature (1)..(1): n is a, c, g, or t
  misc_feature (11)..(12): n is a, c, g, or t
  misc_feature (18)..(18): n is a, c, g, or t
nttdccwwwwnnggwaan

SEQ ID NO: 771 - DNA, 18 bp, Artificial Sequence
  synthetic construct
  misc_feature (1)..(2): n is a, c, g, or t
  misc_feature (4)..(4): n is a, c, g, or t
  misc_feature (18)..(18): n is a, c, g, or t
nnwnccawwwwtrgwwan

SEQ ID NO: 772 - DNA, 16 bp, Artificial Sequence
  synthetic construct
ttwcyawwwwtrgwaa

SEQ ID NO: 773 - DNA, 10 bp, Artificial Sequence
  synthetic construct
ccatttttag

SEQ ID NO: 774 - DNA, 10 bp, Artificial Sequence
  synthetic construct
ccatttttgg

SEQ ID NO: 775 - DNA, 6 bp, Artificial Sequence
  synthetic construct
tgtctc

SEQ ID NO: 776 - DNA, 6 bp, Artificial Sequence
  synthetic construct
tgtctc

SEQ ID NO: 777 - DNA, 9 bp, Artificial Sequence
  synthetic construct
caatwattg

SEQ ID NO: 778 - DNA, 9 bp, Artificial Sequence
  synthetic construct
caatsattg

SEQ ID NO: 779 - DNA, 9 bp, Artificial Sequence
  synthetic construct
  misc_feature (5)..(5): n is a, c, g, or t
caatnattg

SEQ ID NO: 780 - DNA, 9 bp, Artificial Sequence
  synthetic construct
caattatta

SEQ ID NO: 781 - DNA, 7 bp, Artificial Sequence
  synthetic construct
ctaacca

SEQ ID NO: 782 - DNA, 6 bp, Artificial Sequence
  synthetic construct
cacatg

SEQ ID NO: 783 - DNA, 6 bp, Artificial Sequence
  synthetic construct
ggttaa

SEQ ID NO: 784 - DNA, 10 bp, Artificial Sequence
  synthetic construct
ccwwwwwwgg

SEQ ID NO: 785 - DNA, 18 bp, Artificial Sequence
  synthetic construct
gtttacataaatggaaaa

SEQ ID NO: 786 - DNA, 18 bp, Artificial Sequence
  synthetic construct
cttacctttcatggatta

SEQ ID NO: 787 - DNA, 18 bp, Artificial Sequence
  synthetic construct
ctttccatttttagtaac

SEQ ID NO: 788 - DNA, 8 bp, Artificial Sequence
  synthetic construct
tggccgac

SEQ ID NO: 789 - DNA, 8 bp, Artificial Sequence
  synthetic construct
ccacgtgg

SEQ ID NO: 790 - DNA, 8 bp, Artificial Sequence
  synthetic construct
aamaatct

SEQ ID NO: 791 - DNA, 10 bp, Artificial Sequence
  synthetic construct
aaacaatcta

SEQ ID NO: 792 - DNA, 15 bp, Artificial Sequence
  synthetic construct
aaaaaaaatctatga

SEQ ID NO: 793 - DNA, 7 bp, Artificial Sequence
  synthetic construct
  misc_feature (5)..(6): n is a, c, g, or t
acacnng

SEQ ID NO: 794 - DNA, 9 bp, Artificial Sequence
  synthetic construct
taccgacat

SEQ ID NO: 795 - DNA, 9 bp, Artificial Sequence
  synthetic construct
taccgacat

SEQ ID NO: 796 - DNA, 9 bp, Artificial Sequence
  synthetic construct
  misc_feature (8)..(8): n is a, c, g, or t
drccgacnw

SEQ ID NO: 797 - DNA, 8 bp, Artificial Sequence
  synthetic construct
tttcccgc

SEQ ID NO: 798 - DNA, 8 bp, Artificial Sequence
  synthetic construct
tttcccgc

SEQ ID NO: 799 - DNA, 9 bp, Artificial Sequence
  synthetic construct
tctcccgcc

SEQ ID NO: 800 - DNA, 23 bp, Artificial Sequence
  synthetic construct
ttcaagggggcatgtatcttgaa

SEQ ID NO: 801 - DNA, 23 bp, Artificial Sequence
  synthetic construct
ttcaagggggcatgtatcttgaa

SEQ ID NO: 802 - DNA, 23 bp, Artificial Sequence
  synthetic construct
ttcaagggggcatgtatcttgaa

SEQ ID NO: 803 - DNA, 29 bp, Artificial Sequence
  synthetic construct
ggattcaagggggcatgtatcttgaatcc

SEQ ID NO: 804 - DNA, 11 bp, Artificial Sequence
  synthetic construct
taagagccgcc

SEQ ID NO: 805 - DNA, 6 bp, Artificial Sequence
  synthetic construct
gccgcc

SEQ ID NO: 806 - DNA, 9 bp, Artificial Sequence
  synthetic construct
aaaatatct

SEQ ID NO: 807 - DNA, 6 bp, Artificial Sequence
  synthetic construct
wgatar

SEQ ID NO: 808 - DNA, 8 bp, Artificial Sequence
  synthetic construct
ccacgtgg

SEQ ID NO: 809 - DNA, 6 bp, Artificial Sequence
  synthetic construct
cacgtg

SEQ ID NO: 810 - DNA, 6 bp, Artificial Sequence
  synthetic construct
gccgcc

SEQ ID NO: 811 - DNA, 15 bp, Artificial Sequence
  synthetic construct
tgtgtggttaatatg

SEQ ID NO: 812 - DNA, 6 bp, Artificial Sequence
  synthetic construct
ccgtcg

SEQ ID NO: 813 - DNA, 10 bp, Artificial Sequence
  synthetic construct
  misc_feature (5)..(6): n is a, c, g, or t
agaannttct

SEQ ID NO: 814 - DNA, 6 bp, Artificial Sequence
  synthetic construct
gataag

SEQ ID NO: 815 - DNA, 10 bp, Artificial Sequence
  synthetic construct
cgtcaatgaa

SEQ ID NO: 816 - DNA, 13 bp, Artificial Sequence
  synthetic construct
catacgtcgtcaa

SEQ ID NO: 817 - DNA, 8 bp, Artificial Sequence
  synthetic construct
taaatgya

SEQ ID NO: 818 - DNA, 10 bp, Artificial Sequence
  synthetic construct
acgtcataga

SEQ ID NO: 819 - DNA, 10 bp, Artificial Sequence
  synthetic construct
tctacgtcac

SEQ ID NO: 820 - DNA, 7 bp, Artificial Sequence
  synthetic construct
accgaca

SEQ ID NO: 821 - DNA, 12 bp, Artificial Sequence
  synthetic construct
tctaacctacca

SEQ ID NO: 822 - DNA, 8 bp, Artificial Sequence
  synthetic construct
maccwamc

SEQ ID NO: 823 - DNA, 8 bp, Artificial Sequence
  synthetic construct
mtccwacc

SEQ ID NO: 824 - DNA, 9 bp, Artificial Sequence
  synthetic construct
taactsgtt

SEQ ID NO: 825 - DNA, 8 bp, Artificial Sequence
  synthetic construct
taactaac

SEQ ID NO: 826 - DNA, 7 bp, Artificial Sequence
  synthetic construct
amcwamc

SEQ ID NO: 827 - DNA, 9 bp, Artificial Sequence
  synthetic construct
agatcgacg

SEQ ID NO: 828 - DNA, 26 bp, Artificial Sequence
  synthetic construct
atcttatgtcattgatgacgacctcc

SEQ ID NO: 829 - DNA, 11 bp, Artificial Sequence
  synthetic construct
tacacttttgg

SEQ ID NO: 830 - DNA, 20 bp, Artificial Sequence
  synthetic construct
tgacgyaagsrmtkacgymm

SEQ ID NO: 831 - DNA, 8 bp, Artificial Sequence
  synthetic construct
cgcggatc

SEQ ID NO: 832 - DNA, 8 bp, Artificial Sequence
  synthetic construct
gtgatcac

SEQ ID NO: 833 - DNA, 20 bp, Artificial Sequence
  synthetic construct
ttggttttgatcaaaaccaa

SEQ ID NO: 834 - DNA, 15 bp, Artificial Sequence
  synthetic construct
taattgactcaatta

SEQ ID NO: 835 - DNA, 5 bp, Artificial Sequence
  synthetic construct
caaca

SEQ ID NO: 836 - DNA, 6 bp, Artificial Sequence
  synthetic construct
cacctg

SEQ ID NO: 837 - DNA, 8 bp, Artificial Sequence
  synthetic construct
catgcatg

SEQ ID NO: 838 - DNA, 9 bp, Artificial Sequence
  synthetic construct
  misc_feature (2)..(2): n is a, c, g, or t
tncgtacaa

SEQ ID NO: 839 - DNA, 6 bp, Artificial Sequence
  synthetic construct
actttg

SEQ ID NO: 840 - DNA, 16 bp, Artificial Sequence
  synthetic construct
aggggcataatggtaa

SEQ ID NO: 841 - DNA, 9 bp, Artificial Sequence
  synthetic construct
aaaccctaa

SEQ ID NO: 842 - DNA, 8 bp, Artificial Sequence
  synthetic construct
tgacgtgg

SEQ ID NO: 843 - DNA, 5 bp, Artificial Sequence
  synthetic construct
ttgac

SEQ ID NO: 844 - DNA, 8 bp, Artificial Sequence
  synthetic construct
atacgtgt

SEQ ID NO: 845 - DNA, 16 bp, Artificial Sequence
  synthetic construct
aaaacagaataggaaa

SEQ ID NO: 846 - DNA, 8 bp, Artificial Sequence
  synthetic construct
aaattaaa

SEQ ID NO: 847 - DNA, 8 bp, Artificial Sequence
  synthetic construct
aaattagt

SEQ ID NO: 848 - DNA, 8 bp, Artificial Sequence
  synthetic construct
actaattt

SEQ ID NO: 849 - DNA, 12 bp, Artificial Sequence
  synthetic construct
ccaatttaatgg

SEQ ID NO: 850 - DNA, 6 bp, Artificial Sequence
  synthetic construct
actcat

SEQ ID NO: 851 - DNA, 19 bp, Artificial Sequence
  synthetic construct
cttaaaccctaggggtaat

SEQ ID NO: 852 - DNA, 10 bp, Artificial Sequence
  synthetic construct
ttwtactagt

SEQ ID NO: 853 - DNA, 9 bp, Artificial Sequence
  synthetic construct
ataaaacgt

SEQ ID NO: 854 - DNA, 9 bp, Artificial Sequence
  synthetic construct
tgtatatat

SEQ ID NO: 855 - DNA, 9 bp, Artificial Sequence
  synthetic construct
ctcctaatt

SEQ ID NO: 856 - DNA, 10 bp, Artificial Sequence
  synthetic construct
ttgcatgact

SEQ ID NO: 857 - DNA, 6 bp, Artificial Sequence
  synthetic construct
agccac

SEQ ID NO: 858 - DNA, 5 bp, Artificial Sequence
  synthetic construct
gggcc

SEQ ID NO: 859 - DNA, 9 bp, Artificial Sequence
  synthetic construct
ctcaagtga

SEQ ID NO: 860 - DNA, 9 bp, Artificial Sequence
  synthetic construct
gtatgatgg

SEQ ID NO: 861 - DNA, 7 bp, Artificial Sequence
  synthetic construct
gagtgag

SEQ ID NO: 862 - DNA, 8 bp, Artificial Sequence
  synthetic construct
cacgtggc

SEQ ID NO: 863 - DNA, 34 bp, Artificial Sequence; identical to SEQ ID NO: 267
  synthetic construct

SEQ ID NO: 864 - DNA, 34 bp, Artificial Sequence; identical to SEQ ID NO: 268
  synthetic construct

SEQ ID NO: 865 - DNA, 34 bp, Artificial Sequence; identical to SEQ ID NO: 306
  synthetic construct

SEQ ID NO: 866 - DNA, 34 bp, Artificial Sequence; identical to SEQ ID NO: 307
  synthetic construct

SEQ ID NO: 867 - DNA, 68 bp, Artificial Sequence; identical to SEQ ID NO: 309
  synthetic construct

SEQ ID NO: 868 - DNA, 68 bp, Artificial Sequence; identical to SEQ ID NO: 310
  synthetic construct

SEQ ID NO: 869 - DNA, 100 bp, Artificial Sequence; identical to SEQ ID NO: 311
  synthetic construct

SEQ ID NO: 870 - DNA, 100 bp, Artificial Sequence; identical to SEQ ID NO: 312
  synthetic construct

SEQ ID NO: 871 - DNA, 34 bp, Artificial Sequence; identical to SEQ ID NO: 316
  synthetic construct

SEQ ID NO: 872 - DNA, 34 bp, Artificial Sequence; identical to SEQ ID NO: 317
  synthetic construct

SEQ ID NO: 873 - DNA, 34 bp, Artificial Sequence; identical to SEQ ID NO: 318
  synthetic construct
  misc_feature (14)..(16): n is a, c, g, or t
  misc_feature (19)..(21): n is a, c, g, or t

SEQ ID NO: 874 - DNA, 34 bp, Artificial Sequence; identical to SEQ ID NO: 319
  synthetic construct

SEQ ID NO: 875 - DNA, 34 bp, Artificial Sequence; identical to SEQ ID NO: 320
  synthetic construct

SEQ ID NO: 876 - DNA, 34 bp, Artificial Sequence; identical to SEQ ID NO: 321
  synthetic construct

SEQ ID NO: 877 - DNA, 34 bp, Artificial Sequence; identical to SEQ ID NO: 322
  synthetic construct

SEQ ID NO: 878 - DNA, 34 bp, Artificial Sequence; identical to SEQ ID NO: 323
  synthetic construct

SEQ ID NO: 879 - DNA, 34 bp, Artificial Sequence; identical to SEQ ID NO: 324
  synthetic construct

SEQ ID NO: 880 - DNA, 34 bp, Artificial Sequence; identical to SEQ ID NO: 324
  synthetic construct

SEQ ID NO: 881 - DNA, 34 bp, Artificial Sequence; identical to SEQ ID NO: 326
  synthetic construct
  misc_feature (14)..(16): n is a, c, g, or t
  misc_feature (19)..(21): n is a, c, g, or t

SEQ ID NO: 882 - DNA, 34 bp, Artificial Sequence; identical to SEQ ID NO: 327
  synthetic construct
  misc_feature (14)..(16): n is a, c, g, or t
  misc_feature (19)..(21): n is a, c, g, or t

SEQ ID NO: 883 - DNA, 20 bp, Artificial Sequence
  synthetic construct
gtgctctctctcttctgtca

SEQ ID NO: 884 - DNA, 20 bp, Artificial Sequence
  synthetic construct
ctgctctctctcttctgtca

SEQ ID NO: 885 - DNA, 20 bp, Artificial Sequence
  synthetic construct
ttgcttactctcttctgtca

SEQ ID NO: 886 - DNA, 20 bp, Artificial Sequence
  synthetic construct
ccgctctctctcttctgtca

SEQ ID NO: 887 - DNA, 21 bp, Artificial Sequence
  synthetic construct
tggagctcccttcattccaat

SEQ ID NO: 888 - DNA, 21 bp, Artificial Sequence
  synthetic construct
tcgagttcccttcattccaat

SEQ ID NO: 889 - DNA, 21 bp, Artificial Sequence
  synthetic construct
atgagctctcttcaaaccaaa

SEQ ID NO: 890 - DNA, 21 bp, Artificial Sequence
  synthetic construct
tggagctcccttcattccaag

SEQ ID NO: 891 - DNA, 21 bp, Artificial Sequence
  synthetic construct
tagagcttccttcaaaccaaa

SEQ ID NO: 892 - DNA, 21 bp, Artificial Sequence
  synthetic construct
tggagctccattcgatccaaa

SEQ ID NO: 893 - DNA, 21 bp, Artificial Sequence
  synthetic construct
agcagctcccttcaaaccaaa

SEQ ID NO: 894 - DNA, 21 bp, Artificial Sequence
  synthetic construct
cagagctcccttcactccaat

SEQ ID NO: 895 - DNA, 21 bp, Artificial Sequence
  synthetic construct
tggagctcccttcactccaat

SEQ ID NO: 896 - DNA, 21 bp, Artificial Sequence
  synthetic construct
tggagctcccttcactccaag

SEQ ID NO: 897 - DNA, 21 bp, Artificial Sequence
  synthetic construct
tggagctccctttaatccaat

SEQ ID NO: 898 - DNA, 21 bp, Artificial Sequence
  synthetic construct
ttgggatgaagcctggtccgg

SEQ ID NO: 899 - DNA, 21 bp, Artificial Sequence
  synthetic construct
ctgggatgaagcctggtccgg

SEQ ID NO: 900 - DNA, 21 bp, Artificial Sequence
  synthetic construct
ctggaatgaagcctggtccgg

SEQ ID NO: 901 - DNA, 20 bp, Artificial Sequence
  synthetic construct
cgggatgaagcctggtccgg

SEQ ID NO: 902 - DNA, 21 bp, Artificial Sequence
  synthetic construct
gagatcaggctggcagcttgt

SEQ ID NO: 903 - DNA, 21 bp, Artificial Sequence
  synthetic construct
tagatcaggctggcagcttgt

SEQ ID NO: 904 - DNA, 21 bp, Artificial Sequence
  synthetic construct
aagatcaggctggcagcttgt

SEQ ID NO: 905 - DNA, 20 bp, Artificial Sequence
  synthetic construct
gtgctctctctcttctgtca

SEQ ID NO: 906 - DNA, 20 bp, Artificial Sequence
  synthetic construct
ctgctctctctcttctgtca

SEQ ID NO: 907 - DNA, 20 bp, Artificial Sequence
  synthetic construct
ttgcttactctcttctgtca

SEQ ID NO: 908 - DNA, 20 bp, Artificial Sequence
  synthetic construct
ccgctctctctcttctgtca

SEQ ID NO: 909 - DNA, 21 bp, Artificial Sequence
  synthetic construct
tggcatgcagggagccaggca

SEQ ID NO: 910 - DNA, 21 bp, Artificial Sequence
  synthetic construct
aggaatacagggagccaggca

SEQ ID NO: 911 - DNA, 21 bp, Artificial Sequence
  synthetic construct
gggtttacagggagccaggca

SEQ ID NO: 912 - DNA, 21 bp, Artificial Sequence
  synthetic construct
aggcatacagggagccaggca

SEQ ID NO: 913 - DNA, 21 bp, Artificial Sequence
  synthetic construct
aaacaatgcgatccctttgga

SEQ ID NO: 914 - DNA, 21 bp, Artificial Sequence
  synthetic construct
agaccatgcgatccctttgga

SEQ ID NO: 915 - DNA, 21 bp, Artificial Sequence
  synthetic construct
ggtcagagcgatccctttggc

SEQ ID NO: 916 - DNA, 21 bp, Artificial Sequence
  synthetic construct
agacaatgcgatccctttgga

SEQ ID NO: 917 - DNA, 22 bp, Artificial Sequence
  synthetic construct
tcgttcaagaaagcctgtggaa

SEQ ID NO: 918 - DNA, 21 bp, Artificial Sequence
  synthetic construct
cgttcaagaaagcctgtggaa

SEQ ID NO: 919 - DNA, 22 bp, Artificial Sequence
  synthetic construct
tcgttcaagaaagcatgtggaa

SEQ ID NO: 920 - DNA, 22 bp, Artificial Sequence
  synthetic construct
acgttcaagaaagcttgtggaa

SEQ ID NO: 921 - DNA, 21 bp, Artificial Sequence
  synthetic construct
cgttcaagaaagcctgtggaa

SEQ ID NO: 922 - DNA, 300 bp, Artificial Sequence
  synthetic construct
ggacaacaagcaccttcttgccttgcaaggcctcccttccctatggtagccacttgagtggatgacttcaccttaaagctattgattccctaagtgccagacataataggctatacattctctctggtggcaacaatgagccattttggttggtgtggtagtctattattgagttttttttggcaccgtactcccatggagagtagaagacaaactcttcaccgttgtagtcgttgatggtattggtggtgacgacatccttggtgtgcatgcactggtgagtcactgttgtactcggcg

SEQ ID NO: 923 - DNA, 104 bp, Artificial Sequence
  synthetic construct
ggacaacaagcaccttcttgccttgcaaggcctcccttccctatggtagccacttgagtggatgacttcaccttaaagctatcgattccctaagtgccagacat

SEQ ID NO: 924 - DNA, 80 bp, Artificial Sequence
  synthetic construct
ctcttcaccgttgtagtcgttgatggtattggtggtgacgacatccttggtgtgcatgcactggtgagtcactgttgtac

SEQ ID NO: 925 - DNA, 184 bp, Artificial Sequence
  synthetic construct
ggacaacaagcaccttcttgccttgcaaggcctcccttccctatggtagccacttgagtggatgacttcaccttaaagctatcgattccctaagtgccagacatctcttcaccgttgtagtcgttgatggtattggtggtgacgacatccttggtgtgcatgcactggtgagtcactgttgtac

SEQ ID NO: 926 - DNA, 184 bp, Artificial Sequence
  synthetic construct
ctcttcaccgttgtagtcgttgatggtattggtggtgacgacatccttggtgtgcatgcactggtgagtcactgttgtacggacaacaagcaccttcttgccttgcaaggcctcccttccctatggtagccacttgagtggatgacttcaccttaaagctatcgattccctaagtgccagacat

SEQ ID NO: 927 - DNA, 16 bp, Artificial Sequence
  synthetic construct
acgtaagcgcttacgt

SEQ ID NO: 928 - DNA, 12 bp, Artificial Sequence
  synthetic construct
gtaagcgcttac

SEQ ID NO: 929 - DNA, 43 bp, Artificial Sequence; identical to SEQ ID NO: 349
  synthetic construct

SEQ ID NO: 930 - DNA, 43 bp, Artificial Sequence; identical to SEQ ID NO: 350
  synthetic construct

SEQ ID NO: 931 - RNA, 34 nt, Artificial Sequence; identical to SEQ ID NO: 351
  synthetic construct

SEQ ID NO: 932 - DNA, 38 bp, Artificial Sequence; identical to SEQ ID NO: 353
  synthetic construct

SEQ ID NO: 933 - DNA, 38 bp, Artificial Sequence; identical to SEQ ID NO: 354
  synthetic construct

SEQ ID NO: 934 - DNA, 117 bp, Artificial Sequence; identical to SEQ ID NO: 356
  synthetic construct

SEQ ID NO: 935 - DNA, 15 bp, Artificial Sequence
  synthetic construct
aaaaaaaaaaaaaaa

SEQ ID NO: 936 - DNA, 25 bp, Artificial Sequence
  synthetic construct
cacatacacacaaaaataaaaaaga

SEQ ID NO: 937 - DNA, 16 bp, Artificial Sequence
  synthetic construct
gaatatatatatattc

SEQ ID NO: 938 - DNA, 618 bp, Artificial Sequence; identical to SEQ ID NO: 376
  synthetic construct

SEQ ID NO: 939 - DNA, 84 bp, Artificial Sequence
  synthetic construct
tactccctccgtttctttttattagtcgctggatagtgcaattttgcactatccagcgactaataaaaagaaacggagggagta

SEQ ID NO: 940 - DNA, 84 bp, Artificial Sequence
  synthetic construct
tactccctccgtttctttttattagtcgctggatagtgcaaaattgcactatccagcgactaataaaaagaaacggagggagta

SEQ ID NO: 941 - DNA, 28 bp, Artificial Sequence
  synthetic construct
acacgtgacacgtgacacgtgacacgtg

SEQ ID NO: 942 - DNA, 36 bp, Artificial Sequence; identical to SEQ ID NO: 378
  synthetic construct

SEQ ID NO: 943 - DNA, 36 bp, Artificial Sequence
  synthetic construct
aattttaattttaattttaattttaattttaatttt

SEQ ID NO: 944 - DNA, 36 bp, Artificial Sequence
  synthetic construct
tctctttctctttctctttctctttctctttctctt

SEQ ID NO: 945 - DNA, 92 bp, Artificial Sequence; identical to SEQ ID NO: 377
  synthetic construct

SEQ ID NO: 946 - DNA, 92 bp, Artificial Sequence; identical to SEQ ID NO: 380
  synthetic construct

SEQ ID NO: 947 - DNA, 8 bp, Artificial Sequence
  synthetic construct
ctccdccd

SEQ ID NO: 948 - DNA, 9 bp, Artificial Sequence
  synthetic construct
hkcmrmckm

SEQ ID NO: 949 - DNA, 11 bp, Artificial Sequence
  synthetic construct
  misc_feature (8)..(9): n is a, c, g, or t
sacgtggnnvw

SEQ ID NO: 950 - DNA, 9 bp, Artificial Sequence
  synthetic construct
araragarr

SEQ ID NO: 951 - DNA, 9 bp, Artificial Sequence
  synthetic construct
cahcamcah

SEQ ID NO: 952 - DNA, 9 bp, Artificial Sequence
  synthetic construct
raacccwar

SEQ ID NO: 953 - DNA, 8 bp, Artificial Sequence
  synthetic construct
  misc_feature (2)..(2): n is a, c, g, or t
  misc_feature (7)..(7): n is a, c, g, or t
gnatatnc

SEQ ID NO: 954 - RNA, 20 nt, Zea mays
gugcucucucucuucuguca

SEQ ID NO: 955 - RNA, 20 nt, Zea mays
cugcucucucucuucuguca

SEQ ID NO: 956 - RNA, 20 nt, Zea mays
uugcuuacucucuucuguca

SEQ ID NO: 957 - RNA, 20 nt, Zea mays
ccgcucucucucuucuguca

SEQ ID NO: 958 - RNA, 21 nt, Zea mays
uggagcucccuucauuccaau

SEQ ID NO: 959 - RNA, 21 nt, Zea mays
ucgaguucccuucauuccaau

SEQ ID NO: 960 - RNA, 21 nt, Zea mays
augagcucucuucaaaccaaa

SEQ ID NO: 961 - RNA, 21 nt, Zea mays
uggagcucccuucauuccaag

SEQ ID NO: 962 - RNA, 21 nt, Zea mays
uagagcuuccuucaaaccaaa

SEQ ID NO: 963 - RNA, 21 nt, Zea mays
uggagcuccauucgauccaaa

SEQ ID NO: 964 - RNA, 21 nt, Zea mays
agcagcucccuucaaaccaaa

SEQ ID NO: 965 - RNA, 21 nt, Zea mays
cagagcucccuucacuccaau

SEQ ID NO: 966 - RNA, 21 nt, Zea mays
uggagcucccuucacuccaau

SEQ ID NO: 967 - RNA, 21 nt, Zea mays
uggagcucccuucacuccaag

SEQ ID NO: 968 - RNA, 21 nt, Zea mays
uggagcucccuuuaauccaau

SEQ ID NO: 969 - RNA, 21 nt, Zea mays
uugggaugaagccugguccgg

SEQ ID NO: 970 - RNA, 21 nt, Zea mays
cugggaugaagccugguccgg

SEQ ID NO: 971 - RNA, 21 nt, Zea mays
cuggaaugaagccugguccgg

SEQ ID NO: 972 - RNA, 20 nt, Zea mays
cgggaugaagccugguccgg

SEQ ID NO: 973 - RNA, 21 nt, Zea mays
gagaucaggcuggcagcuugu

SEQ ID NO: 974 - RNA, 21 nt, Zea mays
uagaucaggcuggcagcuugu

SEQ ID NO: 975 - RNA, 21 nt, Zea mays
aagaucaggcuggcagcuugu

SEQ ID NO: 976 - RNA, 20 nt, Zea mays
gugcucucucucuucuguca

SEQ ID NO: 977 - RNA, 20 nt, Zea mays
cugcucucucucuucuguca

SEQ ID NO: 978 - RNA, 20 nt, Zea mays
uugcuuacucucuucuguca

SEQ ID NO: 979 - RNA, 20 nt, Zea mays
ccgcucucucucuucuguca

SEQ ID NO: 980 - RNA, 21 nt, Zea mays
uggcaugcagggagccaggca

SEQ ID NO: 981 - RNA, 21 nt, Zea mays
aggaauacagggagccaggca

SEQ ID NO: 982 - RNA, 21 nt, Zea mays
ggguuuacagggagccaggca

SEQ ID NO: 983 - RNA, 21 nt, Zea mays
aggcauacagggagccaggca

SEQ ID NO: 984 - RNA, 21 nt, Zea mays
aaacaaugcgaucccuuugga

SEQ ID NO: 985 - RNA, 21 nt, Zea mays
agaccaugcgaucccuuugga

SEQ ID NO: 986 - RNA, 21 nt, Zea mays
ggucagagcgaucccuuuggc

SEQ ID NO: 987 - RNA, 21 nt, Zea mays
agacaaugcgaucccuuugga

SEQ ID NO: 988 - RNA, 22 nt, Zea mays
ucguucaagaaagccuguggaa

SEQ ID NO: 989 - RNA, 21 nt, Zea mays
cguucaagaaagccuguggaa

SEQ ID NO: 990 - RNA, 22 nt, Zea mays
ucguucaagaaagcauguggaa

SEQ ID NO: 991 - RNA, 22 nt, Zea mays
acguucaagaaagcuuguggaa

SEQ ID NO: 992 - RNA, 21 nt, Zea mays
cguucaagaaagccuguggaa

SEQ ID NO: 993 - DNA, 300 bp, Zea mays; identical to SEQ ID NO: 922

SEQ ID NO: 994 - DNA, 104 bp, Zea mays; identical to SEQ ID NO: 923

SEQ ID NO: 995 - DNA, 80 bp, Zea mays; identical to SEQ ID NO: 924

SEQ ID NO: 996 - DNA, 184 bp, Zea mays; identical to SEQ ID NO: 925

SEQ ID NO: 997 - RNA, 21 nt, Zea mays
uuagaugaccaucagcaaaca

SEQ ID NO: 998 - DNA, 500 bp, Zea mays
agcagcacggcagtagctgcgccattgcacgcctccggccggcggctgcttgtcttgctgcttctgccgcacatccgtgatccgtacgtcgtcacctcaccactcacgcacaagcacaaagagcgttaatttcttgctggagattctattctatttctatggcgtgtccctgatcgaatcctaaatcctaaacctctgtggtgcactgcagggcagaaggtgcttcgttcgttgcaggcctggcgccacgccgtaccgtgcaagcgcgtttgctgatgttcatctaattactgtataataatatctccgggcgaaagagctagcaatcgtcggcgggggaggaggggctcgattgctgctcaaggtgagttgtaattccttggctctggatttccctatctgttggctgttcatggatcatccaatggatggatggcgctccctgttctctacacctgcgtgctcttcttccctcgcctcgccggggtcttgtgtcagtt

SEQ ID NO: 999 - DNA, 21 bp, Zea mays
cgtttgctgatgttcatctaa

SEQ ID NO: 1000 - RNA, 36 nt, Artificial Sequence
  synthetic construct
caucagcaaacgcgcuugcaguuuuagagcuaugcu

SEQ ID NO: 1001 - RNA, 36 nt, Artificial Sequence
  synthetic construct
gcgaaagagcuagcaaucguguuuuagagcuaugcu

SEQ ID NO: 1002 - DNA, 600 bp, Zea mays
ttctccataaaaaaagttgagctaaacagcccctaaagtatatgtagataagcacgattctagtactaaccgcaggacttcttgagcagagcaaaagatggatactccctccgtttctttttattagtcgctggatagtgcaattttgcactatccagcgactaataaaaagaaacggagggagtattaattacagaagaactgacggggcgcatggtttccacgaggtgggcgcaccccggccacatgcatcggcgaaaacaaaatggcagtcgcgaatcgaaagctgccaagctaggccgcatgctggggatgtgtgacacacatatcattggcggtcatggcaggtcgacacgtgtaggcggacgtcatccatcgtcttcatccctatctatctatctatcactcagtacaagccattgctttcgttatcttccgaggcgggcagggcagggcaggttcttccccccttggcacgcaccgcacgcacggcttgcgtggagccaggccagctcgacgatgactacgcggccccggccccgcggcccagtcctccctcctcttcgatcctataaaagcgaggcccagtccctccatctc

SEQ ID NO: 1003 - RNA, 36 nt, Artificial Sequence
  synthetic construct
gcucugcucaagaaguccugguuuuagagcuaugcu

SEQ ID NO: 1004 - RNA, 36 nt, Artificial Sequence
  synthetic construct
uaauuacagaagaacugacgguuuuagagcuaugcu

SEQ ID NO: 1005 - RNA, 36 nt, Artificial Sequence
  synthetic construct
cagcgacuaauaaaaagaaaguuuuagagcuaugcu

SEQ ID NO: 1006 - DNA, 1592 bp, Zea mays
atggtgggtctcgtcggcggcagcacggcgcgggcggagcacgtcgtcgccaacgccggaggggaggcagagtacgtgcgccgcatgcaccgccacgcgccgaccgagcaccagtgcacctccaccctcgtcaagcacatcaaggcgcccgtccacctcgtatgtcccccctccaccccgctctttcctaccctcaacgcggctggccccggtggttcagcggttggactgcctcgcgtctgggctgctatttctcttcggatctggagtcaggagtccttcgtccgatttccaaggccttgttgggtgtctcccccccaccgacgtgttctcgtgatgttgggttaatcgcggctggcgtcaaatcgattggaagctgacgccgtcgatcgcatcgcaggtgtgggagctggtgcggaggttcgaccagccgcagcggtacaagccgttcgtcaggaactgcgtcgtgcgcggggaccagctcgaggtcggcagcctgcgcgacgtcaacgtcaagaccggcctgccggcgacgaccagcaccgagcgcctcgagcagctcgacgacgacctgcacatactcggtgtcaagttcgtcggcggggaccaccgcctccaggtccgtgctgctgccgcccgtttgttgcgtccctgcaaaaatgctctgtttcacgcgccctccttgcttgtcagtgtactccaaattatttttgggggtatgcttgctttgttaccatttctcttttttttaaattaaattgctttcttgtttccatttcactgcagtcctgatcgctggatgctatgcatgaaatgcatttgctgtgcttgcgagattgggcatttactatgagctttgtgacagttaacatcttggtcctgtttggaagctgggattgggaatcaaatccttacatggtttaggagcatccagtttgaacttaaaccattgtagacatctgctgcaataaaaacaattggcttcggtgagaggcactcatcatcagttcaaacttaaaacgagataagccatcggttgattggcctaattaccttgcttcccgtgattgttcgcctcgctgaaaggatatgctcacaacccgtactgttttgacttgttatccacatactatttaagtacgaaaggacatgcgtactactttcatttgttgttcttcgtctagtcttcagactgataatataaggtgaaaaacttcgatgtttcgcgtgctgtcaagtgattgtgaagcaaagtttctgttagtgtcaatgcgtacaggctgcaatggccatctttactcctacttgaagcatatctctgatccacactgatgatgatgagttgtgtgcgccacttttttttctttttctttcagaactactcatccatcataactgtccaccccgagagcattgacgggaggccgggcaccctggtgatcgagtcgttcgtggtcgatgtgcctgatggcaacacgaaggacgagacatgctacttcgtggaggccgtgatcaagtgcaacctcaattctctcgcagaggtatcggagcagctagcagtggagtcacctacgtcgctgatcgatcagtga

SEQ ID NO: 1007 - DNA, 594 bp, Artificial Sequence
  synthetic construct
atggtgggtctcgtcggcggcagcacggcgcgggcggagcacgtcgtcgccaacgccggaggggaggcagagtacgtgcgccgcatgcaccgccacgcgccgaccgagcaccagtgcacctccaccctcgtcaagcacatcaaggcgcccgtccacctcgtgtgggagctggtgcggaggttcgaccagccgcagcggtacaagccgttcgtcaggaactgcgtcgtgcgcggggaccagctcgaggtcggcagcctgcgcgacgtcaacgtcaagaccggcctgccggcgacgaccagcaccgagcgcctcgagcagctcgacgacgacctgcacatactcggtgtcaagttcgtcggcggggaccaccgcctccagaactactcatccatcataactgtccaccccgagagcattgacgggaggccgggcaccctggtgatcgagtcgttcgtggtcgatgtgcctgatggcaacacgaaggacgagacatgctacttcgtggaggccgtgatcaagtgcaacctcaattctctcgcagaggtatcggagcagctagcagtggagtcacctacgtcgctgatcgatcagtga

SEQ ID NO: 1008 - protein, 197 aa, Zea mays; identical to SEQ ID NO: 478

SEQ ID NO: 1009 - DNA, 594 bp, Artificial Sequence
  synthetic construct
atggtgggtctcgtcggcggcagcacggcgcgggcggagcacgtcgtcgccaacgccggaggggaggcagagtacgtgcgccgcatgcaccgccacgcgccgaccgagcaccagtgcacctccaccctcgtcaagcacatcaaggcgcccgtccacctcgtgtgggagctggtgcggaggttcgaccagccgcagcggtacaagccgttcgtcaggaactgcgtcgtgcgcggggaccagctcgaggtcggcagcctgcgcgacgtcaacgtcaagaccggcctgccggcgacgaccagcaccgagcgcctcgagcagctcgacgacgacctgcacatactcggtgtcaagttcgtcggcggggaccaccgcctccagaactactcatccatcataactgtccaccccgagagcattgacgggaggccgggcaccctggtgatcctgtcgttcgtcgtcgatgtgcctgatggcaacacgaaggacgagacatgctacttcgtggaggccgtgatcaagtgcaacctcaattctctcgcagaggtatcggagcagctagcagtggagtcacctacgtcgctgatcgatcagtga

SEQ ID NO: 1010 - RNA, 20 nt, Artificial Sequence
  synthetic construct
ccuggugaucgagucguucg

SEQ ID NO: 1011 - RNA, 135 nt, Artificial Sequence
  synthetic construct
ccuggugaucgagucguucgguuuuagagcuagaaauagcaaguuaaaauaaggcuaguccguuaucaacuugaaaaaguggcaccgagucggugcuuuuuugucgacgguaucgauaagcuugauaucgaauuc

SEQ ID NO: 1012 - RNA, 33 nt, Artificial Sequence
  synthetic construct
gucgacgguaucgauaagcuugauaucgaauuc

SEQ ID NO: 1013 - DNA, 99 bp, Artificial Sequence
  synthetic construct
gacgggaggccgggcaccctggtgatcctgtcgttcgtcgtcgatgtgcctgatggcaacacgaaggaattcgatatcaagcttatcgataccgtcgac

SEQ ID NO: 1014 - DNA, 33 bp, Artificial Sequence
  synthetic construct
gaattcgatatcaagcttatcgataccgtcgac

SEQ ID NO: 1015 - DNA, 300 bp, Zea mays
attaactagtgctgataatatatttacactgtagatttttccgataagtagaaaccaaatatttcaccgccacaaaaggcttcatcccatcagttacccatgtagcaaaaccaaaatacttgtgtgcgagaggccaagagcccaaaccaccgccaaggaaacccccagcccaccaggcgccttcctctataaataccctaactccggtggccgaagttcctcacccattcactcactcatctcaaggcctaggtagcaccgtagcagctactagaagcagctagccagaacaactcgtcc

SEQ ID NO: 1016 - RNA, 36 nt, Artificial Sequence
  synthetic construct
ugggaugaagccuuuuguggguuuuagagcuaugcu

SEQ ID NO: 1017 - RNA, 36 nt, Artificial Sequence
  synthetic construct
ccaaaauacuugugugcgagguuuuagagcuaugcu

SEQ ID NO: 1018 - RNA, 36 nt, Artificial Sequence; identical to SEQ ID NO: 1017
  synthetic construct

SEQ ID NO: 1019 - DNA, 2046 bp, Zea mays
gaggattgcagctcctggatcatatcagaatgtctgtcgctcgccaccccgggcgcactgcattatatttctggcaggtgcgcaatacaatatggcatggggggcacgtagtacggtactgccgtacagctgcgtcagcaaatgccaacttgtgtggtacagctataatctatagaaaaaagaatattatagaagtagtagaagttggcgcgtatggattaaggaaggtttggtttctagtgactaatttagtctctctattttattcaattttgttcctaaattatcaaactaaaatgaagttttgttttttttatataggataatttagagactaaaatagaataaaaatgaatggatgaaaaattagttcctaccaaccaaacaccccttaagagctacttcgagaacctcaaatctccttcgagactggaggagatgaaggtaaaaataaactaattttcccttcaatccttttaattcacaagggggtgcgggtacggaaatgtttactactatactggaaaggtgtctgaaaccgggagaaaagctttgaccagggtggacctgtttatgggatcgaagcggccgttgccccaactggcgactggcgagccaccattgcgcggacccgagattaactatactacaggagtactgtcgggttggtaccaatacgtggcttgggcaaaaagtctggcaggcgccgctgcttgtctgcggtttctatgtgccgatgccatcgcaccggaccggatcgggatgggatcagcggaacatgcgagagcgagcctgcactgcactgcatggccgcgaccgcgtcgtccatcgagccgcctatcattagttggttccactgtctcgccgccgaagcaaggcagcacagcacacatcagcattgcttcccagttcccaatgccccgtcgtcctagccgaggcgggctcagtaccaacccagctgaaactacgagagatgcgctgtgggcaggacagtggtcgagcgaggagtgtacctgtagttaacgaggattttattttactagtgcgtacgtacgtactgtacgtactatgatctctcacgtgctctggtcttatcactcgcttgattatactatgatctttttttccctccacctgctctggtcttatcgctggcacgtgcttttacacggccacttaggactactcacctcgtctcgtcatgcttatctacttcagagcgtcacggacacagcaaggaggagtacgcacacgcagcatggactgcctggagcggggtgtggtgcactaacgcccgcctaattcccggagctgcctgtgccttggacgcccatctctggtttcgcggggagaataataataatttaggcgaaacacgggaacgggtcgtgaggaaaagcctgacatgctgcattacggccggtgccgttcggaccccagttattgatgagccgagtcaccgacctgccaagaaaaggatgccggatcaagggcaggttcacctcatcttagcgcatgcaagcgtcgtccctaaccaaaacatcatcttcatgtctggccgcccgcgcagcggtcccagtgccggcgtggttaacgggagggactgggactggcagggccggctaatggccgacgtgcagtcgcctcgtatgcgtttcccgttgagccatgcatgcagcagagcagcgcgggcggccggtcctgccaccggtggatcgcggccgggcacgtcacggcccggtccccgactgctctggctccatcgccgccaccatgcacccaaagcgatccacccccgatgcatcccttttctctccctgtcagctgggcccatctcgcgtcaccgtagccaggtgccgccccgtcgccccgccccccgatctatatatgctgcccacgggctctcccacttctcccccacatgcacttgctgcagcagccgtaggacacacgcacaccgcctcgacctcgagtccaccactgactccaccacctccccctgttttttttcgacctcgctctgctcatccgcacggccagacagcc

SEQ ID NO: 1020 - RNA, 41 nt, Artificial Sequence
  artificial sequence
uaauuucuacucuuguagauuggacagagcuccaagugacc

SEQ ID NO: 1021 - DNA, 20 bp, Artificial Sequence
  artificial sequence
agcacggacgatcctttacg

SEQ ID NO: 1022 - DNA, 21 bp, Artificial Sequence
  artificial sequence
agctgcttcaatccgacaacc

SEQ ID NO: 1023 - DNA, 573 bp, Artificial Sequence
  artificial sequence
agcacggacgatcctttacgttgtttttaacaaactttgtcagaaaactagcatcattaacttcttaatgacgatttcacaacaaaaaaaggtaacctcgctactaacataacaaaatacttgttgcttattaattatatgttttttaatctttgatcaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggattctaaagaggaagtgcagctcttcttggggaatgctggaactgcaatgcggccattgacagcagctgttactgctgctggtggaaatgcaacgtatgtttcctctctttctctctacaatacttgctggagttagtatgaaacccatgggtatgtctagtggcttatggtgtattggtttttgaacttcagttacgtgcttgatggagtaccaagaatgagggagagacccattggcgacttggttgtcggattgaagcagct

We claim:

1. A method of effecting in a Zea sp. nuclear genome at least one targeted modification of a first predetermined target site in a promoter region upstream of a transcription start site of a first gene and at least one targeted modification of a second predetermined target site in a promoter region upstream of a transcription start site of a second gene, wherein the targeted modifications result in a change of expression in the first gene and a change of expression in the second gene, wherein the targeted modifications comprise an insertion of a predetermined sequence encoded by a single stranded DNA polynucleotide donor molecule that does not have homology arms, wherein each targeted modification is achieved by integrating the predetermined sequence at a double-strand break (DSB) in the first and the second predetermined target sites by non-homologous end joining (NHEJ), wherein the predetermined sequence is integrated about 50 to about 500 nucleotides 5' to the start codon of the coding sequence of the first and second gene, and wherein the predetermined sequence encoded by the single-stranded DNA polynucleotide donor molecule comprises a transcription factor recognition site sequence, thereby modifying the nuclear genome.

2. The method of claim 1, wherein the DSB is introduced into the Zea sp. genome by at least one of the group consisting of:
  (a) a nuclease selected from the group consisting of an RNA-guided nuclease, an RNA-guided DNA endonuclease, a type II Cas nuclease, a Cas9, a type V Cas nuclease, a Cpf1, a CasY, a CasX, a C2c1, a C2c3, an engineered nuclease, a codon-optimized nuclease, a zinc-finger nuclease (ZFN), a transcription activator-like effector nuclease (TAL-effector nuclease), an Argonaute, and a meganuclease or engineered meganuclease;
  (b) a polynucleotide encoding one or more nucleases capable of effecting site-specific alteration of a target nucleotide sequence; and
  (c) a guide RNA (gRNA) for the RNA-guided nuclease, or DNA encoding a gRNA for the RNA-guided nuclease.

3. The method of claim 2, wherein the DSB is introduced by (a) a RNA-guided nuclease or DNA encoding an RNA-guided nuclease and (b) a gRNA or DNA encoding a gRNA, which are introduced into the Zea sp. nuclear genome by contacting with particles or nanoparticles.

4. The method of claim 1, wherein the change of expression in the first gene and the change of expression in the second gene are both associated with improvement, relative to a reference Zea sp. genome lacking the targeted modifications, in resource partitioning.

5. The method of claim 1, wherein the sequence encoded by the single-stranded DNA polynucleotide donor molecule that is integrated into the double-strand break (DSB) located in the promoter region upstream of the transcription start site of the first gene, is identical to the sequence encoded by the single-stranded DNA polynucleotide donor molecule that is integrated into the double-strand break (DSB) located in the promoter region upstream of the transcription start site of the second gene.

6. The method of claim 4, wherein the first gene is associated with nitrogen utilization and the second gene is associated with nitrogen transport.

7. The method of claim 6, wherein the first gene associated with nitrogen utilization is a gene encoding a protein in the glutamine synthetase (GS) enzyme family.

8. The method of claim 4, wherein the first gene has a DNA sequence that is at least 90% identical to SEQ ID NO: 683 or SEQ ID NO: 685, or that encodes a protein that has an amino acid sequence that is at least 90% identical to an amino acid sequence of SEQ ID NO: 684 or SEQ ID NO: 686.

9. The method of claim 4, wherein the first gene is a gene encoding a protein in the glutamine synthase enzyme family and the second gene is a transcription factor Dof1 gene and wherein the targeted modifications result in increased expression of the first and second genes, relative to expression in a reference cell lacking the modifications.

10. The method of claim 4, wherein the first gene is a Gln1.3 gene and the second gene is a Dof1 gene, and wherein the targeted modifications result in increased expression of the first and second genes, relative to expression in a reference cell lacking the modifications.

11. The method of claim 4, wherein the predetermined sequence encoded by a single-stranded DNA polynucleotide donor is a nitrogen-responsive element sequence.

12. The method of claim 4, wherein the predetermined sequence encoded by a single-stranded DNA polynucleotide donor comprises at least one auxin-responsive element sequence.

13. The method of claim 1, wherein the predetermined sequence comprises SEQ ID NO: 343.

* * * * *